(12) United States Patent
Knoll et al.

(10) Patent No.: US 7,014,997 B2
(45) Date of Patent: Mar. 21, 2006

(54) CHROMOSOME STRUCTURAL ABNORMALITY LOCALIZATION WITH SINGLE COPY PROBES

(75) Inventors: Joan H. M. Knoll, Overland Park, KS (US); Peter K. Rogan, Overland Park, KS (US)

(73) Assignee: The Children's Mercy Hospital, Kansas City, MO (US)

( * ) Notice: Subject to any disclaimer, the term of this patent is extended or adjusted under 35 U.S.C. 154(b) by 807 days.

(21) Appl. No.: 09/854,867

(22) Filed: May 14, 2001

(65) Prior Publication Data

US 2003/0224356 A1 Dec. 4, 2003

Related U.S. Application Data

(63) Continuation-in-part of application No. 09/573,080, filed on May 16, 2000, now Pat. No. 6,828,097.

(51) Int. Cl.
*C12Q 1/68* (2006.01)
*C12P 19/34* (2006.01)
*C07H 21/02* (2006.01)
*C07H 21/04* (2006.01)

(52) U.S. Cl. .................. 435/6; 435/91.1; 435/91.2; 526/23.1; 526/23.5; 526/24.31; 526/24.33; 526/25.3

(58) Field of Classification Search .......... 435/6, 435/91.1, 91.2; 536/23.1, 23.5, 24.31, 24.33, 536/25.3
See application file for complete search history.

(56) References Cited

U.S. PATENT DOCUMENTS

| | | |
|---|---|---|
| 5,447,841 A | 9/1995 | Gray et al. |
| 5,721,098 A | 2/1998 | Pinkel et al. |
| 5,756,696 A | 5/1998 | Gray et al. |
| 6,121,419 A * | 9/2000 | Rowley et al. ............ 530/350 |
| 2002/0192692 A1 * | 12/2002 | Palanisamy et al. ........... 435/6 |

FOREIGN PATENT DOCUMENTS

WO   WO01088089   11/2001

OTHER PUBLICATIONS

Tanaka et al. Cancer Genetics and Cytogenetics. 1999. 113: 29–35.*
Rockman et al; Australian Journal of Medical Science; May 1993; 15:56–57.
Tanaka et al. Cancer Genetics and Cytogenetics. 1999. 113: 29–35.

* cited by examiner

*Primary Examiner*—Carla J. Myers
(74) *Attorney, Agent, or Firm*—Hovey Williams LLP

(57) ABSTRACT

Nucleic acid (e.g., DNA) hybridization probes are described which comprise a labeled, single copy nucleic acid which hybridizes to a deduced single copy sequence interval in target nucleic acid of known sequence. The probes, which are essentially free of repetitive sequences, can be used in hybridization analyses without adding repetitive sequence-blocking nucleic acids. This allows rapid and accurate detection of chromosomal abnormalities. The probes are preferably designed by first determining the sequence of at least one single copy interval in a target nucleic acid sequence, and developing corresponding hybridization probes which hybridize to at least a part of the deduced single copy sequence. In practice, the sequences of the target and of known genomic repetitive sequence representatives are compared in order to deduce locations of the single copy sequence intervals. The single copy probes can be developed by any variety of methods, such as PCR amplification, restriction or exonuclease digestion of purified genomic fragments, or direct synthesis of DNA sequences. This is followed by labeling of the probes and hybridization to a target sequence.

23 Claims, 8 Drawing Sheets

(7 of 8 Drawing Sheet(s) Filed in Color)

CHROMOSOME STRUCTURAL ABNORMALITY LOCALIZATION WITH SINGLE COPY PROBES

RELATED APPLICATION

This is a continuation-in-part of Ser. No. 09/573,080 filed May 16, 2000 now U.S. Pat. No. 6,828,097.

SEQUENCE LISTING

A Sequence Listing containing 613 sequences in the form of a computer readable ASCII file in connection with the present invention is incorporated herein by reference and appended hereto as one (1) original compact disk in accordance with 37 CFR 1.821(c), an identical copy thereof in accordance with 37 CFR 1.821(e), and one (1) identical copy thereof in accordance with 37 CFR 1.52(e).

COMPUTER PROGRAM LISTING APPENDIX

A computer program listing appendix containing the source code of a computer program that may be used with the present invention is incorporated herein by reference and appended hereto as one (1) original compact disk, and an identical copy thereof, containing a total of 3 files as follows:

| Date of Creation | Size (Bytes) | File Name |
| --- | --- | --- |
| Apr. 18, 2001 | 26 KB | FINDI.PL |
| Apr. 18, 2001 | 19 KB | PRIM.IN |
| Apr. 18, 2001 | 20 KB | PRIM.WKG |

BACKGROUND OF THE INVENTION

1. Field of the Invention

The present invention is broadly concerned with a method for designing single copy hybridization probes useful in the fields of cytogenetics and molecular genetics for determining the presence of specific nucleic acid sequences in a sample of eukaryotic origin, e.g., the probes may be used to analyze specific chromosomal locations by in situ hybridization as a detection of acquired or inherited genetic diseases. More particularly, the invention pertains to such probes, hybridization methods of use thereof and techniques for developing the probes, where the probes are essentially free of genomic repeat sequences, thereby eliminating the need for disabling of repetitive sequences which is required with conventional probes.

2. Description of the Prior Art

Chromosome abnormalities are associated with various genetic disorders, which may be inherited or acquired. These abnormalities are of three general types, extra or missing individual chromosomes (aneuploidy), extra or missing portions of chromosomes (including deletions, duplications, supernumerary and marker chromosomes), or chromosomal rearrangements. The latter category includes translocations (transfer of a piece from one chromosome onto another chromosome), inversions (reversal in polarity of a chromosomal segment), insertions (transfer of a piece from one chromosome into another chromosome) and isochromosomes (chromosome arms derived from identical chromosomal segments). The abnormalities may be present only in a subset of cells (mosaicism), or in all cells. Inherited or constitutional abnormalities of various types occur with a frequency of about one in every 250 human births, with results which may be essentially benign, serious or even lethal. Chromosomal abnormalities are common and often diagnostic in acquired disorders such as leukemia and other cancers.

Hybridization probes have been developed in the past for chromosome analysis and diagnosis of abnormalities. The probes comprise cloned or amplified genomic sequences or cDNA. For example, U.S. Pat. Nos. 5,447,841, 5,663,319 and 5,756,696 describe hybridization probes in the form of labeled nucleic acids which are complementary to nucleic acid segments within target chromosomal DNA. However, these probes contain repetitive sequences and therefore must be used in conjunction with blocking nucleic acids which are substantially complementary to repetitive sequences in the labeled probes. That is, these prior art probes are either pre-reacted with the blocking nucleic acids so as to bind and block the repetitive sequences therein, or such blocking nucleic acids are present in the hybridization reaction mixture. If the repetitive sequences in the probes are not disabled in some manner, the probes will react with the multiple locations in the target chromosomal DNA where the repetitive sequences reside and will not specifically react with the single copy target sequences. This problem is particularly acute with interspersed repeat sequences which are widely scattered throughout the genome, but also is present with tandem repeats clustered or contiguous on the DNA molecule. The requirement for repeat sequence disabilization by using complementary blocking nucleic acids reduces the sensitivity of the existing probes. Reliable, easily detectable signals require DNA probes of from about 40–100 kb.

The prior art also teaches that cloned probes presumed to contain single copy sequences can be identified based on their lack of hybridization to radiolabeled total genomic DNA. In these other studies, hybridization is first performed with probes that contain pools of clones in which each recombinant DNA clone has been individually selected so that it hybridizes to single-copy sequences or very low copy repetitive sequences. A prerequisite step in this prior art is to identify single copy sequences by experimental hybridization of labeled genomic DNA to a candidate DNA probe by Southern or dot-blot hybridization. Positive hybridization with labeled total genomic DNA usually indicates that the candidate DNA probe contains a repetitive sequence and eliminates it from consideration as a single copy probe. Furthermore, an experimental hybridization of a DNA probe with total genomic DNA may fail to reveal the presence of multicopy repetitive sequences that are not abundant (<100 copies) or are infrequent in the genome. Such sequences represent a small fraction of the labeled genomic DNA and the signal they contribute will be below the limits of detection.

It has also been suggested to physically remove repeat sequences from probes by experimental procedures (Craig et al., *Hum. Genet.,* 100:472–476 (1997); Durm et al., *Biotech.,* 24:820–825 (1998)). This procedure involves prehybridizing a polymerase chain reaction (PCR)-amplified genomic probe with an excess of purified repetitive sequence DNA prior to applying the probe to the DNA target. The resulting purified probe is depleted of repetitive sequences. This procedure is in principle very similar to other procedures that disable the hybridization of repetitive sequences in probes, but the technique is time-consuming and does not provide any advantages over the probes described in U.S. Pat. Nos. 5,447,841 and 5,756,696.

SUMMARY OF THE INVENTION

The present invention overcomes the problem outlined above and provides nucleic acid (e.g., DNA) hybridization probes comprising a labeled, single copy nucleic acid which hybridizes with a deduced single copy sequence interval in target nucleic acid of known sequence. Generally speaking, the probes of the invention are designed by comparing the sequence of a target nucleic acid with known repeat sequences in the genome of which the target is a part; with this information it is possible to deduce the single copy sequences within the target (i.e., those sequences which are essentially free of repeat sequences which, due to the lack of specificity, can mask the hybridization signal of the single copy sequences). As can be appreciated, these initial steps require knowledge of the sequences both of the target and genomic repeats, information which is increasingly available owing to the Human Genome Project and related bioinformatic studies. Furthermore, readily available computer software is used to derive the necessary single copy sequences.

The probes hereof are most preferably complementary to the target sequence, i.e., there is a 100% complementary match between the probe nucleotides and the target sequence. More broadly, less than 100% correspondence probes can be used, so long as the probes adequately hybridize to the target sequence, i.e., there should be at least about 80% sequence identity between the probe and a sequence which is a complement to target sequences, more preferably at least about 90% sequence identity.

Nucleic acid fragments corresponding to the deduced single copy sequences can be generated by a variety of methods, such as PCR amplification, restriction or exonuclease digestion of purified genomic fragments, or direct nucleic acid synthesis. The single copy fragments are then purified to remove any potentially contaminating repeat sequences, such as, for example, by electrophoresis or denaturing high pressure liquid chromatography; this is highly desirable because it eliminates spurious hybridization and detection of unrelated genomic sequences.

The probe fragments may then be cloned into a recombinant DNA vector or directly labeled. The probe is preferably labeled by nick translation using a modified or directly labeled nucleotide. The labeled probe is then denatured and hybridized, preferably to fixed chromosomal preparations on microscope slides or alternately to purified nucleic acid immobilized on a filter, slide, DNA chip, or other substrate. The probes can then be hybridized to chromosomes according to conventional fluorescence in situ hybridization (FISH) methods such as those described in U.S. Pat. Nos. 5,985,549 or 5,447,841; alternately, they can be hybridized to immobilized nucleic acids according to the techniques described in U.S. Pat. Nos. 5,110,920 or 5,273,881. Probe signals may be visualized by any of a variety of methods, such as those employing fluorescent, immunological or enzymatic detection reagents.

Use of the probes of the invention permits more precise chromosomal breakpoint determinations, to a level of resolution heretofore unobtainable by in situ hybridization. In such analyses, initial probe sets can be prepared from regions believed to be on opposite sides of the breakpoint. After an initial assay to confirm this, successive additional probes closer to the breakpoint can be designed, using the single copy strategy. In this fashion, the precise region of the breakpoint can be determined.

It has been found that use of putative single copy probes can determine the existence of heretofore unknown repeat sequences in a genome. The heretofore unknown repeated sequence families can then be included in the repetitive sequence database so that these sequences can be used in the design of subsequent single copy probes.

It was also found that probes may contain sequences that are duplicated or triplicated in the genome which can have stronger hybridization due to the increased length of the target sequence. Also, these duplicons or triplicons can be confirmed, as such, using single copy probes which is more difficult with available commercial probes.

BRIEF DESCRIPTION OF THE DRAWINGS

The patent or application file contains at least one drawing executed in color. Copies of this patent or patent application publication with color drawings will be provided by the Office upon request and payment of the necessary fee.

FIG. 1 illustrates hybridization results using the 5170 bp HIRA probe described in Example 1, and wherein the probe was reacted with purified repetitive DNA sequences;

FIG. 2 illustrates a comparative hybridization identical to that depicted in FIG. 1, using the same 5170 bp HIRA probe but without pre-reaction with purified repetitive DNA sequences;

FIG. 3 illustrates hybridization results using the 3544 bp 15q11-q13 probe pre-reacted with purified repetitive DNA;

FIG. 4 illustrates results in a comparative experiment using the 3544 bp 15q11-q13 probe without pre-reaction with purified repetitive DNA;

FIG. 5 illustrates hybridization results using the 4166 bp, 3544 bp and 2290 bp 15q11-q13 probes described in Example 2, without pre-reaction with purified repetitive DNA sequences;

FIG. 6 illustrates hybridization results using the 5170 bp, 3691 bp, 3344 bp and 2848 bp HIRA probes described in Example 1 without pre-reaction with purified repetitive DNA sequences;

FIG. 7 illustrates hybridization results using the 4823 bp 1p36.3 probe described in Example 2 on metaphase cells of a normal individual, with pre-reaction with purified repetitive DNA sequences;

FIG. 8 illustrates a comparative hybridization result using the 4823 bp 1p36.3 probe of FIG. 7 without pre-reaction with purified repetitive DNA sequences;

FIG. 9 illustrates hybridization results using the 4724 bp and 4823 bp 1p36.3 probes described in Example 2 with pre-reaction with purified repetitive DNA sequences, and wherein single copy hybridizations were observed on homologous pairs of chromosome 1s;

FIG. 10 illustrates a comparative hybridization result using the 4724 bp and 4823 bp 1p36.3 probes described in Example 2 without pre-reaction with purified repetitive DNA sequences, and depicting the same single copy hybridizations shown in FIG. 9;

FIG. 11 illustrates hybridization results using the 4166 bp, 3544 bp and 2290 bp 15q11-q13 probes described in Example 2 without pre-reaction with purified DNA sequences on metaphase cells of a patient affected with Prader-Willi syndrome and known to harbor a deletion of 15q11-q13 sequences for one chromosomal allele, with a star indicating lack of hybridization at the deleted chromosome position and with the arrow indicating hybridization to a single chromosome;

FIG. 12 illustrates hybridization results using the 3691 bp, 3344 bp and 2848 bp HIRA probes described in Example 1 without pre-reaction with purified DNA sequences on metaphase cells of a patient affected with DiGeorge/Velo-Cardio-Facial Syndrome (VCFS) known to harbor a deletion of 22q11.2 sequences, wherein the star indicating lack of hybridization at the deleted chromosome position and the arrow indicating a normal homolog;

DETAILED DESCRIPTION OF THE PREFERRED EMBODIMENT

Figure 1:
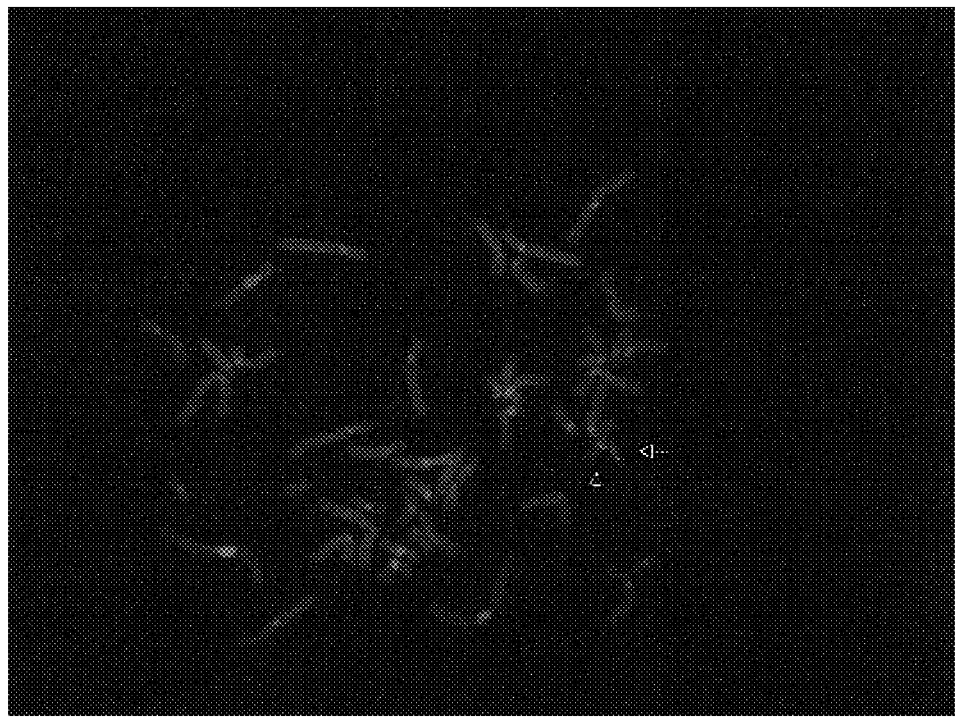
FIGS. 1–12 are respective CCD camera images of FISH experiments wherein various gene-specific digoxigenin-dUTP labeled probes were hybridized on metaphase cells and detected with rhodamine conjugated antibody to digoxigenin and where the chromosomes were counterstained with 4,6-diamidino-2-phenylindole (DAPI). Chromosomes with one or both chromatids hybridized are indicated by arrows whereas a star indicates the absence of normally expected hybridizations. In particular.

The present invention is concerned with nucleic acid (e.g., DNA) hybridization probes useful for detection of genetic or neoplastic disorders. The probes are in the form of labeled nucleic acid fragments or a collection of labeled nucleic acid fragments whose hybridization to a target sequence can be detected. The invention also pertains to methods of developing, generating and labeling such probes, and to uses thereof.

The labeled probes hereof may be used with any nucleic acid target that may potentially contain repetitive sequences. These target sequences may include, but are not limited to chromosomal or purified nuclear DNA, heteronuclear RNA, or mRNA species that contain repetitive sequences as integral components of the transcript. In the ensuing detailed explanation, the usual case of a DNA target sequence and DNA probes is discussed; however, those skilled in the art will understand that the discussion is equally applicable (with art-recognized differences owing to the nature of the target sequences and probes) to other nucleic acid species.

An important characteristic of the probes of the invention is that they are composed of "single copy" or "unique" DNA sequences which are both complementary to at least a portion of the target DNA region of interest and are essentially free of sequences complementary to repeat sequences within the genome of which the target region is a part. Accordingly, a probe made up of a single copy or unique sequence is complementary to essentially only one sequence in the corresponding genome.

Very recently, it has been discovered that the human genome contains highly similar domains which have been termed duplicons when they are present in two non-allelic copies or triplicons when present in three copies in the genome (Ji et al., *Genome Res.,* 10:597–610 (2000)). Duplication or triplication of chromosomal domains containing such sequences were recent evolutionary events, based on the fact that non-human primates, in some instances, do not contain multiple copies of these sequences, and on the high degree of sequence similarity between different copies of paralogous sequences. These low copy duplicons (or triplicons) are to be distinguished from classic repetitive sequence families, which tend to either be interspersed throughout the genome or to be tandemly reiterated hundreds to thousands of times in the same chromosomal interval; therefore, probes from duplicons or triplicons are for purposes of the present invention deemed to be within the ambit of "single copy" probes.

These duplicons or triplicons have evolved so recently that the sequence and organization of an entire genomic domain—which comprises complex, near-single copy segments and adjacent members of known repetitive sequence families—is completely conserved in each duplicon or triplicon segment. Duplicon and triplicon lengths of several kilobases to megabase sizes have been reported (International Genome Sequencing Consortium, *Nature,* 409:860–922 (2001)). The duplicons/triplicons are often tandemly arranged, and are almost always present on the same chromosome, and are therefore clustered in the genome. The length of the interval separating paralogous probe sequences is dictated by the size of the duplicated/triplicated domain, the orientation of the duplicons (or triplicons) relative to each other (ie. direct or inverted), and the length of unrelated sequence intervals, if any, which separate the duplicons/triplicons.

In the context of the present invention, the term "single copy" with reference to a nucleic acid sequence refers to a sequence which is strictly unique (i.e., which is complementary to one and one only sequence in the corresponding genome) but also covers duplicons and triplicons. Stated otherwise, a "single copy" probe in preferred forms will hybridize to three or less locations in the genome.

As used herein, a "repeat sequence" is a sequence which repeatedly appears in the genome of which the target DNA is a part, with a sequence identity between repeats of at least about 60%, more preferably at least about 80%, and which is of sufficient length or has other qualities which would cause it to interfere with the desired specific hybridization of the probe to the target DNA (i.e., the probe would hybridize with multiple copies of the repeat sequence). Generally speaking, a repeat sequence appears at least about 10 times in the genome (more preferably at least about 50 times, and most preferably at least about 200 times) and has a length of at least about 50 nucleotides, and more preferably at least about 100 nucleotides. Repeat sequences can be of any variety (e.g., tandem, interspersed, palindromic or shared repetitive sequences with some copies in the target region and some elsewhere in the genome), and can appear near the centromeres of chromosomes, distributed over a single chromosome, or throughout some or all chromosomes.

Normally, with but few exceptions, repeat sequences do not express physiologically useful proteins.

Repetitive sequences occur in multiple copies in the haploid genome. The number of copies can range from at least about 10 to hundreds of thousands, wherein the Alu family of repetitive DNA are exemplary of the latter numerous variety. The copies of a repeat may be clustered or interspersed throughout the genome. Repeats may be clustered in one or more locations in the genome, for example, repetitive sequences occurring near the centromeres of each chromosome, and variable number tandem repeats (VNTRS) (Nakamura et al., *Science,* 235:1616 (1987)); or the repeats maybe distributed over a single chromosome for example, repeats found only on the X chromosome as described by Bardoni et al. (*Cytogenet. Cell Genet.,* 46:575 (1987)); or the repeats may be distributed over all the chromosomes, for example, the Alu family of repetitive sequences.

Simple repeats of low complexity can be found within genes but are more commonly found in non-coding genomic sequences. Such repeated elements consist of mono-, di-, tri-, tetra-, or penta-nucleotide core sequence elements arrayed in tandem units. Often the number of tandem units comprising these repeated sequences varies at the identical locations among genomes from different individuals. These repetitive elements can be found by searching for consecutive runs of the core sequence elements in genomic sequences.

As used herein, "sequence identity" refers to a relationship between two or more polynucleotide sequences, namely a reference sequence and a given sequence to be compared with the reference sequence. Sequence identity is determined by comparing the given sequence to the reference sequence after the sequences have been optimally aligned to produce the highest degree of sequence similarity, as determined by the match between strings of such sequences. Upon such alignment, sequence identity is ascertained on a position-by-position basis, e.g., the sequences are "identical" at a particular position if at that position, the nucleotides are identical. The total number of such position identities is then divided by the total number of nucleotides or residues in the reference sequence to give % sequence identity. Sequence identity can be readily calculated by known methods, including but not limited to, those described in Computational Molecular Biology, Lesk A. N., ed., Oxford University Press, New York (1988); Biocomputing: Informatics and Genome Projects, Smith D. W., ed., Academic Press, New York (1993); Computer Analysis of Sequence Data, Part I, Griffin A. M., and Griffin H. G., eds., Humana Press, New Jersey (1994); Sequence Analysis in Molecular Biology, von Heinge G., Academic Press (1987); Sequence Analysis Primer, Gribskov M. and Devereux J., eds., M. Stockton Press, New York (1991); and Carillo H., and Lipman D., SIAM J. Applied Math., 48:1073 (1988). Preferred methods to determine the sequence identity are designed to give the largest match between the sequences tested. Methods to determine sequence identity are codified in publicly available computer programs which determine sequence identity between given sequences. Examples of such programs include, but are not limited to, the GCG program package (Devereux et al., *Nuc. Ac. Res.,* 12(1):387 (1984)), BLASTP, BLASTN and FASTA (Altschul et al., *J. Molec. Biol.,* 215:403–410 (1990)). The BLASTX program is publicly available from NCBI and other sources (BLAST Manual, Altschul et al., NCBI, NLM, NIH, Bethesda, Md. 20894; Altschul et al., *J. Molec. Biol.,* 215:403–410 (1990)). These programs optimally align sequences using default gap weights in order to produce the highest level of sequence identity between the given and reference sequences. As an illustration, by a polynucleotide having a nucleotide sequence having at least, for example, 95% "sequence identity" to a reference nucleotide sequence, it is intended that the nucleotide sequence of the given polynucleotide is identical to the reference sequence except that the given polynucleotide sequence may include up to 5 differences per each 100 nucleotides of the reference nucleotide sequence. In other words, in a polynucleotide having a nucleotide sequence having at least 95% identity relative to the reference nucleotide sequence, up to 5% of the nucleotides in the reference sequence may be deleted or substituted with another nucleotide, or a number of nucleotides up to 5% of the total nucleotides in the reference sequence may be inserted into the reference sequence. Inversions in either sequence are detected by these computer programs based on the similarity of the reference sequence to the antisense strand of the homologous test sequence. These variants of the reference sequence may occur at the 5' or 3' terminal positions of the reference nucleotide sequence or anywhere between those terminal positions, interspersed either individually among nucleotides in the reference sequence or in one or more contiguous groups within the reference sequence.

The single copy probes of the invention preferably should have a length of at least about 50 nucleotides, and more preferably at least about 100 nucleotides. Probes of this length are sufficient for Southern blot analyses. However, if other analyses such as FISH are employed, the probes should be somewhat longer, i.e., at least about 500 nucleotides, and more preferably at least about 2000 nucleotides in length. The probes can be used to detect virtually any type of chromosomal rearrangement, such as deletions, duplications, insertions, additions, inversions or translocations.

In order to develop probes in accordance with the invention, the sequence of the target DNA region must be known. The target region may be an entire chromosome or only portions thereof where rearrangements have been identified. With this sequence knowledge, the objective is to determine the boundaries of single copy or unique sequences within the target region. This is preferably accomplished by inference from the locations of repetitive sequences within the target region. Normally, the sequence of the target region is compared with known repeat sequences from the corresponding genome, using available computer software. Once the repeat sequences within the target region are identified, the intervening sequences are deduced to be single copy (i.e., the sequences between adjacent repeat sequences).

Optimal alignment of the target and repetitive sequences for comparison may be conducted by the local homology algorithm of Smith et al., *Adv. Appl. Math.,* 2:482 (1981), by the homology alignment algorithm of Needleman et al., *J. Mol. Biol.,* 48:443 (1970). The results obtained from the heuristic methods (Pearson et al., *Proc. Natl. Acad. Sci.,* 85:244 (1988); Altschul et al., *J. Molec. Biol.,* 215:403–410 (1990)) are generally not as comprehensive as the methods of Smith et al. (1981) and Needleman et al., (1970). However, they are faster than these methods.

Once the single copy sequence information is obtained, certain of the single copy sequences (normally the longest) are used to design hybridization probes. In this regard, probes may be of varying "complexity" as defined by Britten et al., *Methods of Enzymol.,* 29:363 (1974) and as further explained by Cantor et al., *Biophysical Chemistry: Part III: The Behavior of Biological Macromolecules,* pp.

1228–1230. The complexity of selected probes is dependent upon the application for which it is designed. In general, the larger the target area, the more complex the probe. The complexity of a probe needed to detect a set of sequences will decrease as hybridization sensitivity increases. At high sensitivity and low background, smaller and less complex probes can be used.

With current hybridization techniques, it is possible to obtain reliable, easily detectable signals with relatively small probes in accordance with the invention. A readily detectable signal was obtained with a probe on the order of 2 kb in length, using FISH technology. This sensitivity of the present method is improved compared to the prior art (U.S. Pat. No. 5,756,696) because the probes of the present invention are homogeneous single copy sequences. However, smaller amplified segments, each comprising non-repetitive sequences, may also be used in combination as probes to achieve adequate signals for in situ hybridization. Complex single copy probes that hybridize to duplicated or triplicated targets can also increase hybridization signals.

One application of the use of multiple fragment probes is in the detection of translocations between different chromosomes. Proportionately increasing the complexity of the probe also permits analysis of multiple compact regions of the genome simultaneously. For a single chromosome, the portion of the probe targeted to one side of the breakpoint can be labeled and detected differently from that targeted to the other side of the breakpoint so that the derivative or translocated chromosome is detected by one label and is distinguishable from the intact normal chromosome which has both labels.

The invention makes it possible to produce single copy probes at a higher genomic density than possible using conventional probes. Chromosomes 21 and 22 have been comprehensively sequenced, and it has been determined that adjacent single copy intervals tend to be clustered on these chromosomes. For example, on chromosome 22,39% of single copy intervals are separated by only 500–1000 bp. Single copy intervals $\geq$2.3 kb are separated, on average, by 29.2 kb on chromosome 21 and by 22.3 kb on chromosome 22.

In order to estimate the size of genomic intervals required to develop single copy probes, the probability of detecting at least one single copy sequence in overlapping, uniform-length genomic intervals on chromosomes 21q and 22q was determined. Single copy segments $\geq$2.0 kb in length are found in the majority of 100 kb genomic intervals of these chromosomes (96% of chromosome 22q and 88% of chromosome 21q). Increasing the size of the genomic sequence to 150 kb results in 99% coverage of chromosome 22q and 96% of chromosome 21q. Therefore, single copy probes should be more or less 2 kb to ensure comprehensive coverage (at least once per 100–150 kb) of chromosomes 21 and 22. Assuming that single copy sequences are similarly distributed on other chromosomes, it should be feasible to develop probes for in situ hybridization analysis of most clinically relevant chromosomal rearrangements.

Once appropriate single copy sequences in the chromosomal region of interest have been identified, PCR is preferably used for amplifying the appropriate DNA to obtain probes. PCR is a well known technique for amplifying specific DNA segments in geometric progression and relies upon repeated cycles of DNA polymerase-catalyzed extension from a pair of oligonucleotide primers with homology to the 5' end and to the complement of the 3' end of the DNA segment to be amplified.

The nucleic acid (e.g., DNA) that serves as the PCR template may be single stranded or double stranded, but when the DNA is single stranded, it will typically be converted to double stranded. The length of the template DNA may be as short as 50 bp, but usually will be at least about 100 bp long, and more usually at least about 150 bp long, and may be as long as 10,000 bp or longer, but will usually not exceed 50,000 bp in length, and more usually will not exceed 20,000 bp in length. The DNA may be free in solution, flanked at one or both ends with non-template DNA, present in a cloning vector such as a plasmid and the like, with the only criteria being that the DNA be available for participation in the primer extension reaction. The template DNA may be derived from a variety of different sources, so long as it is complementary to the target chromosomal or immobilized DNA sequence. The amount of template DNA that is combined with the other reagents will range from about 1 molecule to 1 pmol, usually from about 50 molecules to 0.1 pmol, and more usually from about 0.01 pmol to 100 fmol. The oligonucleotide primers with which the template nucleic acid is contacted will be of sufficient length to provide for hybridization to complementary template DNA under annealing conditions but will be of insufficient length to form stable hybrids with template DNA under polymerization conditions. The primers will generally be at least about 10 nucleotides (nt) in length, usually at least 15 nt in length and more usually at least 16 nt in length and may be as long as 30 nt in length or longer, where the length of the primers will generally range from 18 to 50 nt in length, usually from about 20 to 35 nt in length. The yield of longer amplification products can be enhanced using primers of 30 to 35 nt and high fidelity polymerases (described in U.S. Pat. No. 5,436,149).

To maximize the signal intensity obtained during in situ hybridization, primer sequence pairs are preferred which, upon amplification, produce a DNA fragment that spans nearly the entire length of each single-copy genomic sequence interval. Hence, contiguous or closely spaced (software excludes pairs that are separated by $\leq$70% of the length of the single copy interval) primer pairs are generally excluded from consideration for producing probes for in situ hybridization. With the exception of cytogenetic preparations, this criterion is generally not applicable for probes that are hybridized to immobilized cloned or synthetic nucleic acid targets, since signal intensities of shorter probes are usually adequate due to the increased number of target molecules.

However, in order to optimize the yield and kinetics of the PCR reaction, the desired primer sequences are also subject to other criteria. First, a primer sequence should not be substantially self-complementary or complementary to the second primer. In particular, potential primer sequences are excluded which could result in the formation of stable hybrids involving the 3' terminus of the primer and either another sequence in the same or the second primer (defined as $\geq$6 base pairs). Additionally, the $T_m$ of one member of the primer pair should occur within 2° C. of its counterpart, which enables them to denature and anneal to the template nearly simultaneously. Software is well known in the art to identify primer sequences that satisfy all of the preferred criteria (see for example genome.wi.mit.edu/ftp/pub/software/primer.0.5/ or oligo.net/Oligo_6_tour.htm).

The PCR reaction mixture will normally further comprise an aqueous buffer medium which includes a source of monovalent ions, a source of divalent cations and a buffering agent. Any convenient source of monovalent ions, such as KCl, K-acetate, $NH_4$-acetate, K-glutamate, $NH_4Cl$, ammonium sulfate, and the like may be employed, where the amount of monovalent ion source present in the buffer will typically be present in an amount sufficient to provide for a conductivity in a range from about 500 to 20,000, usually from about 1000 to 10,000, and more usually from about 3,000 to 6,000 microohms. The divalent cation may be magnesium, manganese, zinc and the like, where the cation will typically be magnesium. Any convenient source of magnesium cation may be employed, including $MgCl_2$, Mg-acetate, and the like. The amount of $Mg^{-2}$-present in the buffer may range from 0.5 to 10 mM, but will preferably range from about 2 to 4 mM, more preferably from about 2.25 to 2.75 mM and will ideally be at about 2.45 mM. Representative buffering agents or salts that may be present in the buffer include Tris, Tricine, HEPES, MOPS and the like, where the amount of buffering agent will typically range from about 5 to 150 mM, usually from about 10 to 100 mM, and more usually from about 20 to 50 mM, where in certain preferred embodiments the buffering agent will be present in an amount sufficient to provide a pH ranging from about 6.0 to 9.5, where most preferred is pH 7.3 at 72° C. Other agents which may be present in the buffer medium include chelating agents, such as EDTA, EGTA and the like.

Also present in the PCR reaction mixtures is a melting point reducing agent, i.e., a reagent that lowers the melting point of DNA. Suitable melting point reducing agents are those agents that interfere with the hydrogen bonding interaction of two nucleotides, where representative base pair destabilization agents include: betaine, formamide, urea, thiourea, acetamide, methylurea, glycinamide, and the like, where betaine is a preferred agent. The melting point reducing agent will typically be present in amounts ranging from about 20 to 500 mM, usually from about 50 to 200 mM and more usually from about 80 to 150 mM.

In preparing the PCR reaction mixture, the various constituent components may be combined in any convenient order. For example, the buffer may be combined with primer, polymerase and then template DNA, or all of the various constituent components may be combined at the same time to produce the reaction mixture.

Following preparation of the PCR reaction mixture, it is subjected to a plurality of reaction cycles, where each reaction cycle comprises: (1) a denaturation step, (2) an annealing step, and (3) a polymerization step. The number of reaction cycles will vary depending on the application being performed, but will usually be at least 15, more usually at least 20 and may be as high as 60 or higher, where the number of different cycles will typically range from about 20 to 40. For methods where more than about 25, usually more than about 30 cycles are performed, it may be convenient or desirable to introduce additional polymerase into the reaction mixture such that conditions suitable for enzymatic primer extension are maintained.

The denaturation step comprises heating the reaction mixture to an elevated temperature and maintaining the mixture at the elevated temperature for a period of time sufficient for any double stranded or hybridized nucleic acid present in the reaction mixture to dissociate. For denaturation, the temperature of the reaction mixture will usually be raised to, and maintained at, a temperature ranging from about 85 to 100° C. usually from about 90 to 98° C., and more usually from about 93 to 96° C. for a period of time ranging from about 3 to 120 seconds, usually from about 5 to 30 seconds.

Following denaturation, the PCR reaction mixture will be subjected to conditions sufficient for primer annealing to template DNA present in the mixture. The temperature to which the reaction mixture is lowered to achieve these conditions will usually be chosen to provide optimal efficiency and specificity, and will generally range from about 50 to 75° C., usually from about 55 to 70° C. and more usually from about 60 to 68° C. Annealing conditions will be maintained for a period of time ranging from about 15 seconds to 30 minutes, usually from about 30 seconds to 5 minutes.

Following annealing of primer to template DNA or during annealing of primer to template DNA, the reaction mixture will be subjected to conditions sufficient to provide for polymerization of nucleotides to the primer ends in manner such that the primer is extended in a 5' to 3' direction using the DNA to which it is hybridized as a template, i.e. conditions sufficient for enzymatic production of primer extension product. To achieve polymerization conditions, the temperature of the reaction mixture will typically be raised to or maintained at a temperature ranging from about 65 to 75° C., usually from about 67 to 73° C. and maintained for a period of time ranging from about 15 seconds to 20 minutes, usually from about 30 seconds to 5 minutes.

The above cycles of denaturation, annealing and polymerization may be performed using an automated device, typically known as a thermal cycler. Thermal cyclers that may be employed are described in U.S. Pat. Nos. 5,612,473; 5,602,756; 5,538,871; and 5,475,610.

Based on all the previous criteria, a series of primers were produced and validated by PCR using genomic DNA from normal individuals. Knowledge of suitable primers will necessarily define the corresponding PCR-produced probes in accordance with the invention. Thus, adjacent pairs of sequences identified as SEQ ID Nos. 429–446 and 480–613, beginning with SEQ ID No.429, are respective forward/reverse PCR primers developed for the production of specific useful probes. Hence, a useful probe may be produced using a combination of SEQ ID Nos. 429 and 430, and additional probes are defined by the succeeding pairs of adjacent SEQ IDs. Broadly speaking, certain preferred probes of the invention should have at least about 80% sequence identity, and more preferably about 90% sequence identity, relative to the probes defined by the above-described adjacent pairs of primer sequences.

In addition to the PCR, DNA fragments corresponding to unique sequences can also be obtained by a variety of other methods, including but not limited to deletion mutagenesis, restriction digestion, direct synthesis and DNA ligation.

If the genomic fragment is obtained by amplification or purification from DNA containing repetitive sequences, the fragment must then be purified prior to labeling and hybridization. Purification of homogeneously-sized DNA fragments can be accomplished by a variety of methods, including but not limited to electrophoresis and high pressure liquid chromatography. In the preferred method, amplified fragments are separated according to size by gel electrophoreses in Seakem LE Agarose using Tris Acetate buffer (Sambrook, Fritsch & Maniatis, Molecular Cloning: A Laboratory Manual [Cold Spring Harbor Laboratory Press, 1989]), stained with a dye such as ethidium bromide or Syber-Green, visualized with ultraviolet light (300 nm), excised from the gel using a scalpel. Each DNA fragment is then recovered from the gel fragment using a Micro-con 100 (Millipore, Watertown, Mass.) column by spin centrifugation.

Phenol-chloroform extraction of the amplified DNA is not an adequate method of purification. When this approach was tested, this purification technique resulted in nonspecific hybridization to all chromosomes along their entire length, which is consistent with the pattern produced by hybridization of repetitive sequences (data not shown). This occurs because, during the PCR process, DNA polymerase extends the replicated strand past the position of the second primer into adjacent repetitive sequences if the initial template contains genomic DNA sequences. These extension products which are longer than the amplification product, are present in all such PCR reactions. Since, in the present method, repetitive sequences are adjacent to the segments being amplified, the extension products are likely to contain such sequences. Phenol-chloroform extraction of PCR reactions does not remove such extension products. PCR reaction mixtures containing these sequences may hybridize to repetitive genomic DNA in addition to the target sequence. Hence, isolation of the purified genomic amplification fragment (whether it is obtained directly from genomic DNA or by PCR), is a preferred embodiment of the subject invention and would not be obvious to one skilled in the art.

Insertion of the purified fragments into plasmids, bacteriophages, or artificial chromosome cloning vehicles capable of being propagated in E. coli, yeast, or other species may be desirable to reduce the cost and labor required for repeated preparation of single copy DNA probes. A variety of cloning vectors have been optimized for rapid ligation and selection for vectors containing PCR products (for example: U.S. Pat. Nos. 5,487,993 and 5,766, 891). If the probe will be used in multiple hybridizations, then the cloned recombinant form will be less expensive to produce in large quantities than by iterative PCR amplification from the same genomic DNA template. In addition, genomic insert in the cloned probe does not have to be isolated during purification, since the fragment recombined with vector is propagated in the absence of any other genomic DNA that could potentially contain repetitive sequences. Finally, the cloned vehicle provides a potentially inexhaustible source of probe, whereas natural genomic DNA templates may have to be reisolated from cell lines or from other sources. Single copy DNA fragments obtained by PCR amplification as described above are isolated according to size by gel electrophoresis and purified by columns as is well known in the art.

These fragments are then labeled with nonisotopic identifying label such as a fluorophore, an enzymatic conjugate, or one selected from the group consisting of biotin or other moieties recognized by avidin, streptavidin, or specific antibodies. There are several types of non-isotopic identifying labels. One type is a label which is chemically bound to the probe and serves as the means for identification and localization directly. An example of this type would be a fluorochrome moiety which upon application of radiation of proper wavelengths will become excited into a high energy state and emit fluorescent light. The probes can be synthesized chemically or preferably be prepared using the methods of nick-translation (Rigby et al., *J. Mol Biol.*, 113:237–251, (1977)) or Klenow labeling (Feinberg et al., *Anal. Biochem.*, 137:266–267, (1984)) in the conventional manner using a reactant comprising the identifying label of choice (but not limited to) conjugated to a nucleotide such as dATP or dUTP. The fragments are either directly labeled with a fluorophore-tagged nucleotide or indirectly labeled by binding the labeled duplex to a fluorescently-labeled antibody that recognizes the modified nucleotide that is incorporated into the fragment as described below. Nick-translations (100 μl reaction) utilize endonuclease-free DNA polymerase I (Roche Molecular Biochemicals, Indianapolis, Ind.) and DNase I (Worthington Biochemical Corporation, Lakewood, N.J.). Each fragment is combined with DNA polymerase (20 units/microgram DNA), DNase I (10 microgram/100 μl reaction), labeled nucleotide (0.05 mm final) and nick translation buffer. The reaction is performed at 15° C. for 45 minutes to 2 hours and yields a variety of labeled probe fragments of different nucleotide sizes in the 100 to 500 bp size range.

Other methods for labeling and detecting probes in common use may be applied to the single-copy DNA probes produced by the present method. These include: fluorochrome labels (which resolve labeling on individual chromatids which serves as an affirmation that hybridization occurred unequivocably, and further allows detection precisely at site of hybridization rather than at some distance away), chemical reagents which yields an identifiable change when combined with the proper reactants (for example, alkaline phosphatase, horseradish peroxidase and galactosidase, each of which reacts and provide a detectable color change that identifies the presence and position of the target sequence), and indirect linkage mechanism of specifically binding entities (such as the biotin-avidin system in which the probe is preferably joined to biotin by conventional methods and added to an avidin- or streptavidin-conjugated fluorochrome or enzyme which provides the specificity for attaching the fluorochrome or enzyme to the probe).

It will be recognized that other identifying labels may also be used with the described probes. These include fluorescent compositions such as energy transfer groups, conjugated proteins, antibodies and antigens, or radioactive isotopes.

Chromosomal hybridization and detection are a preferred use of DNA probes generated by the present invention. DNA probes generated by the present method may be hybridized either directly to complementary nucleic acids in cells (in situ hybridization) or to nucleic acids immobilized on a substrate. A preferred use of the method is in situ hybridization, which is well known in the art, being described in U.S. Pat. Nos. 5,985,549; 5,447,841; 5,756, 696; 5,869,237. Based on early work of Gall and Pardue (*Proc. Natl. Acad. Sci.*, 63:378–383, 1969), isotopic in situ hybridization was established in the 1970s (see Gerhard et al., *Proc. Natl. Acad. Sci.*, 78:3755–3759, 1981 and Harper et al., *Proc. Natl. Acad. Sci.*, 78:4458–4460, 1981 as examples) and subsequently nonisotopic in situ hybridization was established. The technique of nonisotopic in situ hybridization is reviewed and a protocol is provided for use in chromosomal hybridization by Knoll and Lichter, in *Current Protocols in Human Genetics*, Vol. 1, Unit 4.3 (Green-Wiley, New York, 1994) and in U.S. Pat. No. 5,985, 549. The technique relies on the formation of duplex nucleic acid species, in which one strand is derived from a labeled probe molecule and the second strand comprises the target to be detected. Target molecules may comprise chromosomes or cellular nucleic acids. Numerous methods have been developed to label the probe and visualize the duplex.

The method of the present invention is intended to be used with any nucleic acid target containing repetitive sequences. The sample containing the target nucleic acid sequence can be prepared from cellular nuclei, morphologically intact cells (or tissues), chromosomes, other cellular material components, or synthetically produced nucleic acids. The samples may be obtained from the fluids or tissues of a mammal, preferably human, which are suspected of being afflicted with a disease or disorder either from a biopsy or post-mortem, or from plants.

As an example, chromosomal preparations can be made in the following manner: phytohemagglutinin-stimulated peripheral lymphocytes are cultured in RPMI 1640 medium containing 10% fetal calf serum for 72 hours at 37° C. Ethidium bromide (100 ug/10 ml final) is added 1–½ hours prior to harvest. Colcemid (1 ug/10 ml final) is added during the final 20 min of incubation with ethidium bromide. The cells are then pelleted by centrifugation and incubated preferably in 0.075 M KCl at 37° C. for about 20 minutes. Cells are then pelleted again and fixed in 3 changes of Camoy's fixative (3:1 methanol:acetic acid volumetric ratio) using conventional cytogenetic techniques. [For a review of chromosome preparation from peripheral blood cells, see Bangs and Donlon in Dracopoli et al., eds., Current Protocols in Human Genetics, Vol. 1, Unit 4.1 (Green-Wiley, New York, 1994)]. The nuclei or cells in suspension can then be dropped onto clear glass coverslips or microscope slides in a humid environment to promote chromosome spreading. The coverslips or microscope slides can then be preferentially air dried overnight, aged or stored until required for use in in situ hybridization.

Immediately prior to chromosomal denaturation in the in situ hybridization procedure, the dried or stored chromosome preparations can be pretreated in prewarmed 2×SSC (components are in Sambrook, Fritsch & Maniatis, Molecular Cloning: A Laboratory Manual [Cold Spring Harbor Laboratory Press, 1989]) for 30 minutes at 37° C. followed by dehydration in an ethanol series (2 minutes each in 70%, 80%, 90% and 100% ethanol).

When the target nucleic acid sequence is DNA, DNA in the sample can be denatured by heat or alkali. [See Harper et al., Proc. Natl. Acad. Sci., 78:4458–60 (1981), for alkali denaturation and Gall et al., Proc. Natl. Acad. Sci., 63:370–383 (1969)]. Denaturation is carried out so that the DNA strands are separated with minimal shearing, degradation or oxidation.

In the preferred current method, the labeled single copy probe is resuspended in deionized formamide and denatured at 70–75° C. The chromosomal template is denatured in a solution containing 70% formamide/2×SSC, pH 7.0 followed by dehydration in an ethanol series (2 minutes each in cold 70% ethanol and room temperature 80, 90 and 100% ethanol). Hybridization of the labeled probe to the corresponding template is carried out in a solution containing 50% formamide/2×SSC/10% dextran sulfate/BSA [bovine serum albumin; 1 mg/ml final] for a few hours to overnight. The length of time depending on the complexity of the probe that is utilized. After hybridization, non-hybridizing excess probe is removed by a washing procedure. The duplexes are treated with a series of 15–30 minute washes: first with a solution of 50% formamide/2×SSC at 39–45° C., then 2×SSC at 39–45° C., followed by a 15–30 minute wash at room temperature in 1×SSC. The hybridized sequences are detected by relevant means. For example, digoxigenin-dUTP can be but is not limited to detection by an antibody to digoxigenin such as rhodamine or fluorescein conjugated antibody (Roche Molecular Biochemicals, Indianapolis, Ind.). Following detection, spurious detection reagents are removed by washing in varying SSC and SSC/triton-X concentrations, the chromosomes are counterstained with a dye such as DAPI and the hybridized preparation is mounted in an antifade solution such as Vectashield (Vector Laboratories, Burlingame, Calif.). The cells are examined by fluorescence microscopy with the appropriate filter sets and imaged with a charge coupled device (CCD).

An important aspect of the present invention is that the probe or target DNA does not require pre-reaction with a non-specific nucleic acid competitor such as purified repetitive DNA or that the probe does not require experimental verification that the single copy fragments or recombinant cloned probes do not contain repetitive sequences (U.S. Pat. Nos. 5,985,549; 5,447,841; 5,663,319; 5,756,696) because the probes are single copies without repetitive elements. This results in a significantly improved signal to noise ratio. A signal to noise ratio is defined as a ratio of the probability of the probe detecting a bona fide signal of hybridization of the target nucleic acid sequence to that of the probability of detecting the background caused by non-specific binding of the labeled probe.

The hybridization reactions carried out using the probes of the invention are themselves essentially conventional. As indicated, two exemplary types of hybridizations are the Southern blot and FISH techniques, well known to those skilled in the art. However, the visual patterns resulting from use of the probes, termed indicator patterns, are extremely useful tools for cytogenetic analyses, especially molecular cytogenetic analyses. These indicator patterns facilitate microscopic and/or flow cytometric identification of normal and abnormal chromosomes and characterization of the genetic abnormalities. Since multiple compatible methods of probe visualization are available, the binding patterns of different components of the probes can be distinguished, for example, by color. Thus, the invention is capable of producing virtually any desired indicator pattern on the chromosomes visualized with one or more colors (a multi-color indicator pattern) and/or other indicator methods.

Preferred indicator patterns derived from using the probes of the invention comprise one or more "bands," meaning a reference point in a genome comprising a target DNA sequence with a probe bound thereto, and wherein the resulting duplex is detectable by some indicator. Depending on hybridization washes and the detection conditions, a band can extend from the narrow context of a sequence providing a reliable signal to a single chromosome region to multiple regions on single or plural chromosomes. The indicator bands from the probes hereof are to be distinguished from bands produced by pretreatment and chemical staining. The probe-produced bands of the present invention are based upon the complementarity of the DNA sequences, whereas bands produced by chemical staining depend upon natural characteristics of the chromosomes (such as structure or protein composition), but not by hybridization to the DNA sequences thereof. Furthermore, chemical staining techniques are useful only in connection with metaphase chromosomes, whereas the probe-produced bands of the present invention are useful for both metaphase and interphase chromosomes.

The following examples set forth the preferred techniques employed for the development, generation, labeling and use of specific DNA probes designed to hybridize to a target DNA sequence in a genome. It is to be understood, however, that these examples are provided by way of illustration and nothing therein should be taken as a limitation upon the overall scope of the invention.

EXAMPLE 1

Development of HIRA Gene Probe

A known genetic disorder on human chromosome 22 involves a deletion of one HIRA gene in chromosome band 22q11.2, i.e., in normal individuals, there are two copies of the HIRA gene, whereas in affected individuals, only one copy is present. This deletion is considered to be a cause of haploinsufficiency syndromes such as DiGeorge and Velo-Cardio-Facial Syndromes (VCFS), because insufficient amounts of gene product(s) may disrupt normal embryonic development (Fibison et al., Amer. J. Hum. Genet., 46:888–95 (1990); Consevage et al., Amer. J. Cardiol., 77:1023–1205 (1996)). Other syndromes including Cat Eye Syndrome and derivative chromosome 22 syndrome result from an excess of genomic sequences from this region (Mears et al., Amer. J. Hum. Genet., 55:134–142 (1994); Knoll et al., Amer. J. Med. Genet., 55:221–224 (1995)). Typically individuals with these syndromes have supernumerary derivative chromosome 22s.

Initially, a computer-based search using the search term "HIRA" was performed using Entrez Nucleotide software at the National Library of Medicine website. This identified a series of cDNA sequences for the HIRA gene in GenBank. The full length cDNA sequence was selected (GenBank Accession No. X81844), having 3859 bp. This cDNA sequence was then compared with the genome sequence which included draft sequences at the National Library of Medicine (ncbi.nlm.nih.gov/genome/seq/page.cgi?F=HsBlast.html&&ORG=Hs). This was done in order to determine whether genomic sequences of sufficient length were available for probe development. This comparison confirmed that the entire HIRA genomic sequence was known, and that the coding sequence interval spanned a length of 100,836 bp in the chromosome. Since the available contiguous genomic sequence in GenBank exceeded the length of the coding interval, it was possible to select an interval longer than the coding region in order to include sequences from the gene promoter at the 5' end and untranslated sequences and polyadenylation signal at the 3' end. A total genomic interval of approximately 103 kb was thus selected. Position 1 of this ~103 kb interval corresponds to position 798,334 in GenBank Accession number NT_001039.

In the next step, the selected 103 kb genomic interval was compared with known high-complexity repeat sequence family members or consensus sequences that are aligned with the test genomic sequences (SEQ ID Nos. 1–428) and all combinations of low-complexity tandem repeat sequences of at least 17 nucleotides in length (mono-, di-, tri-, and tetranucleotide units) known to be present in the human genome (SEQ ID Nos. 447–479). This comparison was done using the publicly available CENSOR program which can be found at the Genetic Information Research Institute website (girinst.org). This program utilizes the Smith-Waterman global alignment comparison algorithm to determine the locations and distribution of repeat sequences within the genomic interval. A Smith-Waterman alignment of repetitive with genomic sequences was performed with the following parameters: Length of margin sequence: 50 nt, minimum length to extract insertion: 12 nt, minimum margin to combine matching fragments: 30, similarity threshold: 22, similarity threshold to always keep match: 35, ratio threshold: 2.8, relative similarity threshold: 28, gap constant D1: 2.95, gap constant D2: 1.90, and mismatch penalty: –1.0. This analysis generated the following table, which details the coordinates of repetitive sequence family members found in and adjacent to the human HIRA gene coding sequence.

TABLE 1

| HIRA position (bp) | | Repeat Family | SEQ ID NO. | Position (bp) in Seq. Listing Corresponding to HIRA Match | |
|---|---|---|---|---|---|
| Begin | End | | | Begin | End |
| 798411 | 798434 | (AC) | 452 | 1 | 24 |
| 798983 | 799395 | MLT2A1 | 444 | 1 | 434 |
| 801257 | 801348 | CHESHIRE_A | 420 | 132 | 223 |
| 801367 | 801729 | L1ME_ORF2 | 425 | 757 | 1089 |
| 801746 | 802032 | Alu-Jb | 2 | 2 | 289 |
| 802033 | 802308 | L1ME_ORF2 | 425 | 1090 | 1380 |
| 802355 | 802434 | L1MB6_5 | 77 | 1629 | 1710 |
| 802448 | 802798 | L1M3D_5 | 66 | 996 | 1348 |
| 802811 | 803100 | Alu-Y | 2 | 1 | 290 |
| 803104 | 803189 | L1M3D_5 | 66 | 907 | 995 |
| 803199 | 803454 | Alu-Jb | 2 | 5 | 290 |
| 803472 | 803545 | Alu-Spqxz | 2 | 2 | 76 |
| 803548 | 804061 | L1MEC_5 | 345 | 1860 | 2392 |
| 804079 | 804365 | Alu-Sz | 2 | 6 | 290 |
| 804476 | 804559 | L1P_MA2 | 348 | 6242 | 6321 |
| 804625 | 804885 | L1ME_ORF2 | 425 | 2287 | 2568 |
| 804936 | 804997 | MLT1E2 | 106 | 198 | 260 |
| 805011 | 805077 | MLT1E1 | 105 | 420 | 484 |
| 805110 | 805211 | L1PBA_5 | 359 | 103 | 204 |
| 805212 | 805862 | L1PBA_5 | 359 | 1089 | 1738 |
| 805933 | 805989 | Alu-J | 2 | 234 | 290 |
| 805991 | 806489 | L1PBA_5 | 359 | 1749 | 2247 |
| 806510 | 806624 | L1 | 59 | 1659 | 1773 |
| 806628 | 806917 | Alu-Sz | 2 | 1 | 290 |
| 806919 | 807254 | L1M2_5 | 61 | 2377 | 2716 |
| 807301 | 808176 | L1P_MA2 | 348 | 3516 | 4425 |
| 808179 | 808469 | Alu-Sz | 2 | 1 | 290 |
| 808476 | 808734 | L1 | 59 | 3268 | 3525 |
| 808735 | 809426 | L1ME_ORF2 | 425 | 1411 | 2105 |
| 809429 | 809860 | L1P_MA2 | 348 | 5607 | 6044 |
| 809861 | 809993 | Alu-Jb | 2 | 2 | 134 |
| 809996 | 810282 | Alu-Jb | 2 | 2 | 290 |
| 810345 | 811040 | L1 | 59 | 4711 | 5402 |
| 811041 | 811221 | L1PB3 | 358 | 151 | 333 |
| 811226 | 811513 | Alu-Sx | 2 | 1 | 287 |
| 811515 | 812032 | L1PB1 | 357 | 330 | 863 |
| 812096 | 812394 | Alu-Jb | 2 | 1 | 288 |
| 812474 | 812698 | Alu-Jb | 2 | 5 | 229 |
| 812721 | 812836 | Alu-Jo | 2 | 2 | 117 |
| 812862 | 812901 | L1P_MA2 | 348 | 4315 | 4354 |
| 812903 | 813078 | L1 | 59 | 3028 | 3222 |
| 813079 | 814102 | L1ME_ORF2 | 425 | 1113 | 2166 |
| 814323 | 814410 | MER1B | 315 | 242 | 337 |
| 814411 | 814557 | CHARLIE3 | 7 | 1 | 281 |
| 814780 | 814916 | L1MB7 | 78 | 9 | 143 |
| 815061 | 815181 | Alu-Y | 2 | 1 | 134 |
| 815420 | 815452 | LTR67 | 279 | 99 | 131 |
| 816487 | 816772 | Alu-Sx | 2 | 5 | 290 |
| 817180 | 817270 | L1MCC_5 | 335 | 1384 | 1473 |
| 817332 | 817620 | Alu-Sg | 2 | 1 | 290 |
| 817634 | 817909 | Alu-Sq | 2 | 1 | 288 |
| 817943 | 818227 | Alu-Sx | 2 | 2 | 289 |
| 818368 | 818578 | HAL1 | 18 | 1346 | 1547 |
| 818631 | 818791 | LINE2 | 362 | 2280 | 2464 |
| 818824 | 818889 | Alu-S | 2 | 223 | 290 |
| 818890 | 819185 | LINE2 | 362 | 2465 | 2749 |
| 819328 | 819450 | LINE2 | 362 | 1925 | 2049 |
| 819565 | 819757 | LINE2 | 362 | 2273 | 2498 |
| 823604 | 823892 | Alu-Jo | 2 | 2 | 290 |
| 826836 | 827042 | Alu-Sxzg | 2 | 84 | 290 |
| 827922 | 827977 | MIR | 99 | 105 | 160 |
| 830762 | 831371 | L1MEC_5 | 345 | 1498 | 2123 |
| 831396 | 831685 | Alu-Sx | 2 | 2 | 290 |
| 831687 | 831774 | L1MEC_5 | 345 | 2117 | 2205 |
| 831778 | 832066 | Alu-Sx | 2 | 1 | 290 |
| 832155 | 832288 | Alu-FLA | 2 | 5 | 134 |
| 832317 | 832431 | L1MC2 | 79 | 666 | 786 |
| 832442 | 832735 | Alu-Sz | 2 | 1 | 289 |
| 832742 | 832992 | L1MC2 | 79 | 787 | 1077 |
| 833004 | 833170 | L1ME_ORF2 | 425 | 172 | 340 |
| 833177 | 834590 | TIGGER1 | 148 | 1 | 1477 |
| 834592 | 834642 | Alu-Jb | 2 | 156 | 207 |
| 834799 | 834877 | Alu-Jb | 2 | 208 | 290 |
| 834907 | 835194 | Alu-Y | 2 | 1 | 289 |

TABLE 1-continued

| HIRA position (bp) | | | | Position (bp) in Seq. Listing Corresponding to HIRA Match | |
|---|---|---|---|---|---|
| Begin | End | Repeat Family | SEQ ID NO. | Begin | End |
| 835198 | 835590 | TIGGER1 | 148 | 1468 | 1900 |
| 835597 | 835888 | Alu-Sx | 2 | 1 | 290 |
| 835946 | 835979 | L1P_MA2 | 348 | 4654 | 4689 |
| 836060 | 836177 | MER2 | 316 | 229 | 345 |
| 836203 | 836486 | Alu-Sx | 2 | 7 | 290 |
| 836497 | 836712 | MER2 | 316 | 1 | 228 |
| 838478 | 838760 | Alu-Sz | 2 | 1 | 288 |
| 838822 | 839069 | Alu-Sx | 2 | 1 | 288 |
| 839086 | 839373 | Alu-Sz | 2 | 1 | 289 |
| 840297 | 840926 | L1MB7 | 78 | 269 | 915 |
| 841062 | 841306 | L1MB7 | 78 | 7 | 249 |
| 841323 | 841382 | L1ME_ORF2 | 425 | 3053 | 3116 |
| 841408 | 841697 | Alu-Sq | 2 | 1 | 290 |
| 841705 | 841828 | Alu-Jo | 2 | 1 | 136 |
| 841829 | 842012 | L1ME_ORF2 | 425 | 2870 | 3052 |
| 842744 | 842871 | MER86 | 239 | 51 | 183 |
| 842879 | 843107 | Alu-Spqxz | 2 | 3 | 230 |
| 843109 | 843271 | Alu-Jo | 2 | 9 | 175 |
| 847056 | 847210 | MER104 | 293 | 1 | 179 |
| 847256 | 847351 | L1ME4 | 343 | 128 | 224 |
| 847413 | 847551 | MIR | 99 | 65 | 218 |
| 847570 | 847695 | L1ME4 | 343 | 1 | 127 |
| 847865 | 848137 | Alu-Y | 2 | 1 | 290 |
| 848171 | 848458 | Alu-Sg | 2 | 1 | 290 |
| 848493 | 848564 | L1PA7 | 355 | 35 | 105 |
| 848646 | 848928 | Alu-Sc | 2 | 5 | 290 |
| 849186 | 849435 | L1ME_ORF2 | 425 | 2527 | 2796 |
| 849450 | 849745 | Alu-Sx | 2 | 5 | 289 |
| 850114 | 850249 | L1P_MA2 | 348 | 5447 | 5610 |
| 850250 | 850761 | L1 | 59 | 3478 | 4017 |
| 850824 | 850942 | L1ME_ORF2 | 425 | 1128 | 1265 |
| 851588 | 851614 | (T) | 449 (complement) | 1 | 27 |
| 851749 | 851881 | L1ME2 | 341 | 357 | 523 |
| 852607 | 852853 | L1MA10 | 72 | 664 | 918 |
| 852863 | 853156 | Alu-Sc | 2 | 1 | 290 |
| 853176 | 853211 | L1MA10 | 72 | 628 | 663 |
| 853212 | 853267 | L1MA9 | 75 | 987 | 1041 |
| 853491 | 853779 | Alu-Sz | 2 | 1 | 290 |
| 859137 | 859435 | Alu-Sx | 2 | 1 | 290 |
| 859436 | 859456 | (A) | 449 | 1 | 21 |
| 859570 | 859805 | L1ME3A | 342 | 215 | 442 |
| 859806 | 860289 | L1ME2 | 341 | 375 | 879 |
| 860318 | 860605 | Alu-Y | 2 | 1 | 290 |
| 862194 | 862481 | Alu-Sg | 2 | 1 | 290 |
| 865060 | 865350 | Alu-Sq | 2 | 1 | 290 |
| 867521 | 867800 | Alu-Jb | 2 | 1 | 288 |
| 867836 | 867876 | MIR | 99 | 157 | 196 |
| 869546 | 869802 | LINE2 | 362 | 123 | 413 |
| 869923 | 870118 | LINE2 | 362 | 1251 | 1450 |
| 870124 | 870202 | Alu-J | 2 | 48 | 132 |
| 870203 | 870296 | LINE2 | 362 | 1451 | 1592 |
| 870316 | 870666 | LINE2 | 362 | 1708 | 2097 |
| 871000 | 871075 | LINE2 | 362 | 2617 | 2736 |
| 871650 | 871935 | Alu-Jo | 2 | 1 | 290 |
| 871936 | 871960 | (GAAAAA) | 4 | 1 | 28 |
| 872154 | 872444 | Alu-Sc | 2 | 1 | 289 |
| 874867 | 874990 | L1MB7 | 78 | 529 | 676 |
| 878120 | 878408 | Alu-Sx | 2 | 1 | 290 |
| 881003 | 881054 | MLT1G | 109 | 217 | 268 |
| 881130 | 881266 | MLT1G | 109 | 269 | 480 |
| 881293 | 881346 | MLT1G | 109 | 415 | 469 |
| 881762 | 881891 | LINE2B | 363 | 85 | 229 |
| 882448 | 882740 | Alu-Sb0 | 2 | 1 | 290 |
| 883566 | 883716 | Alu-Sz | 2 | 1 | 288 |
| 883782 | 883977 | Alu-Sc | 2 | 2 | 290 |
| 883988 | 884329 | L1P_MA2 | 348 | 5600 | 5935 |
| 884333 | 884623 | Alu-Sp | 2 | 1 | 290 |
| 884624 | 885134 | L1ME_ORF2 | 425 | 2431 | 2975 |
| 885160 | 885456 | Alu-Jb | 2 | 9 | 290 |
| 885460 | 885742 | L1ME_ORF2 | 425 | 2949 | 3252 |
| 885744 | 886031 | Alu-Sx | 2 | 1 | 288 |
| 886032 | 886082 | Alu-Sp | 2 | 291 | 341 |
| 886083 | 886166 | L1MB7 | 78 | 137 | 220 |
| 886168 | 886454 | Alu-Sc | 2 | 1 | 290 |
| 886535 | 887059 | L1MB7 | 78 | 345 | 901 |
| 887169 | 887460 | Alu-Y | 2 | 1 | 289 |
| 887485 | 887748 | L1MD2 | 337 | 794 | 1072 |
| 887752 | 887779 | LOR1I | 366 | 395 | 422 |
| 888253 | 888318 | LINE2 | 362 | 2440 | 2505 |
| 888385 | 888548 | LINE2 | 362 | 2579 | 2739 |
| 888865 | 888893 | LOR1I | 366 | 394 | 422 |
| 889006 | 889296 | Alu-Jb | 2 | 5 | 290 |
| 889446 | 889548 | Alu-Jo | 2 | 188 | 290 |
| 889549 | 889677 | L1PB3 | 358 | 770 | 897 |
| 889842 | 890133 | Alu-Sq | 2 | 1 | 290 |
| 890515 | 890797 | Alu-Sz | 2 | 1 | 283 |
| 890858 | 890972 | L1ME2 | 341 | 769 | 885 |
| 890986 | 891024 | LOR1I | 366 | 396 | 434 |
| 891028 | 891063 | LTR66 | 266 | 173 | 207 |
| 891126 | 891536 | LINE2 | 362 | 1980 | 2452 |
| 891545 | 891670 | LTR16A1 | 382 | 9 | 128 |
| 891688 | 891963 | LTR16A | 381 | 146 | 429 |
| 892907 | 893013 | LINE2 | 362 | 2636 | 2747 |
| 893851 | 893924 | MLT1L | 119 | 47 | 119 |
| 894528 | 894849 | Alu-Sx | 2 | 1 | 290 |
| 895825 | 895903 | LINE2 | 362 | 2592 | 2664 |
| 895912 | 896083 | MER20 | 317 | 46 | 216 |
| 897067 | 897299 | MER20 | 317 | 2 | 217 |
| 897492 | 897624 | Alu-FLA | 2 | 2 | 136 |
| 897977 | 898261 | Alu-Sc | 2 | 1 | 290 |

The lengths of the non-repetitive intervals were calculated from these data. For example, a non-repetitive interval of 5358 bp was determined between coordinate positions 853779 and 859137 which delineate the boundaries of adjacent Alu-Sz and Alu-Sx repetitive elements. Next, the non-repetitive intervals were sorted based on their respective lengths. Four of these non-repetitive intervals were selected for probe development, namely the above-referenced 5358 bp sequence, a 3847 bp sequence (coordinates 819757 and 823604), a 3785 bp sequence (coordinates 843271 and 847056), and a 3130 bp sequence (coordinates 874990 and 878120).

In the next step, the long PCR technique was used to amplify portions of the four identified single copy intervals. The technique followed for amplification of the 5358 bp interval is described in detail below. Similar techniques were followed for amplification of the remaining three single copy intervals.

Probes of maximal length were desired for FISH experiments. However, in order to optimize the PCR reaction that generated these probes, other constraints had to be met, which resulted in amplification products somewhat shorter than the entire non-repetitive sequence interval. The Prime computer program was employed to optimize the selection of primers for PCR (Genetics Computer Group software package, Madison Wis.). The PCR primers which were optimized for long PCR were constrained as follows: size of 30–35 nucleotides; GC content of 50–80%; melting temperature of 65–70° C.; the primer was not permitted to self-anneal at the 3' end with hairpins of greater than 8 nucleotides; the primer was not permitted to self-anneal at any position with greater than 14; and the primer was permitted to anneal only at a single position in the target sequence and primer-primer annealing was limited at the 3' end to less than 8 bp and at any other point less than 14 bp. In addition, certain constraints were applied to the amplified PCR product in order to optimize long PCR: length of 5100–5358 nucleotides; GC content of 40–60%; melting temperature of 70–95° C.; difference in forward and reverse primer melting points less than 2° C. This yielded a possible 517 forward primers and 382 reverse primers, and a total of 928 possible products. The Prime program using the foregoing constraints rank ordered potential primer pairs. The top ranked primers were selected for synthesis, as set forth in the following Table 2. These primers were commercially produced (Oligos, Etc., Wilsonville, Oreg.).

The detailed probe labeling, hybridization, removal of non-specifically bound probe, and probe detection procedures are described by Knoll and Lichter, In: Dracopoli et al., (eds), "Current Protocols in Human Genetics Volume 1", Unit 4.3 (Green-Wiley, New York, 1994). Briefly, in order to label the probe, a standard nick translation reaction was carried out (Rigby et al., J. Mol. Biol., 113:237–251, (1977)) using digoxigenin-11-dUTP as the label. This yielded a series of overlapping 300–500 bp labeled fragments, which together comprised the 5170 bp probe.

The labeled probe fragments were then precipitated by adding $\frac{1}{10}$ V NaOAc plus 2.5 V 95% EtOH and carrier DNA

TABLE 2

| Gene | Chromosome Band | GenBank Accession No., Chromosome Genomic Sequence | Coordinates of Longest Single Copy Intervals, Beginning/End | Forward PCR Primer Coordinates, Beginning/End | Reverse PCR Primer Coordinates, Beginning/End | PCR Primer SEQ ID Nos., Forward/Reverse | Probe Length (bp) |
|---|---|---|---|---|---|---|---|
| HIRA | 22q11.2 | NT_001039 | 853779/859137 | 853946/853975 | 859116/859085 | 429/430 | 5170 |
| HIRA | 22q11.2 | NT_001039 | 819757/823604 | 819901/819933 | 823592/823559 | 431/432 | 3691 |
| HIRA | 22q11.2 | NT_001039 | 843271/847056 | 843602/843631 | 846946/846915 | 433/434 | 3344 |
| HIRA | 22q11.2 | NT_001039 | 874990/878120 | 875226/875257 | 878074/878042 | 435/436 | 2848 |

Using these primers, a long PCR reaction (50 μl) was performed using 1 microgram of high molecular weight genomic DNA (purified by phenol extraction) and 200 μM of each oligonucleotide primer to amplify the 5170 bp probe. Specifically, high fidelity DNA polymerase (LA-Taq, Takara Chemical Co.) was employed using the following thermal cycling protocol:

Step 1—94° C.—5 minutes
Step 2—98° C.—20 seconds
Step 3—65° C.—7 minutes
Step 4—14 times to Step 2
Step 5—98° C.—20 seconds
Step 6—65° C.—7 minutes +15 s/cycle
Step 7—14 times to Step 5
Step 8—72° C.—10 minutes
Step 9—0° C.
Step 10—END Because amplification of the 5170 bp probe is less efficient than amplification of shorter fragments, the initial PCR reaction did not yield sufficient quantities of probe for multiple hybridization experiments. Therefore, a 4 μl aliquot of the original DNA amplification reaction was reamplified using the following protocol: Step 1—94° C.—1.5 minutes, followed by Steps 2–10 of the original PCR reaction. Sufficient quantities of the 5170 bp probe were obtained. An alternative to reamplification is to increase Step 7 by at least 10 cycles.

The amplified product was then purified by gel electrophoresis followed by column chromatography. First, the amplified product was separated on a 0.8% Seakem LE agarose gel (FC Bioproducts) in 1× modified TAE buffer. The gel was then stained with ethidium bromide and visualized with UV light. The fragment corresponding to the correct interval size was excised in an Ultrafree-DA spin column (Millipore) and centrifuged at 5000 g for 10 minutes. The DNA was recovered in solution and precipitated in $\frac{1}{10}$ V NaOAc and 2.5 V 95% EtOH (overnight) at −20° C. The precipitated DNA was then centrifuged, rinsed with cold 70% EtOH, air dried and resuspended in 20 μl of sterile deionized water. The DNA was checked on a 0.8% agarose gel (Sigma) to determine DNA concentration.

(overnight, −20° C.). On the following day, the precipitated DNA was centrifuged, lyophilized, and resuspended in deionized sterile water at a concentration of 125 ng/20 μl.

A comparison set of hybridizations were carried out with normal denatured human metaphase chromosomes, using the labeled probe fragments with and without blocking nucleic acid of the type described in U.S. Pat. Nos. 5,447,841, 5,663,319 and 5,756,696. Twenty μl of resuspended labeled probe was then lyophilized and resuspended in 10 μl of deionized formamide and denatured for 5 minutes at 70–75° C. to yield single-stranded nucleic acids. For comparison, probes were pre-reacted with purified repetitive DNA by adding 125 ng (or 20 μl) of labeled probe to 10 micrograms of $C_0t$ 1 DNA (Life Technologies) and lyophilizing the mixture. This mixture was then denatured for 5 minutes at 70° C. followed by pre-reaction (or pre-annealing) for 30 minutes at 37° C. to convert the single stranded repetitive sequences in the probe to double stranded nucleic acid. This disables the hybridization between the sequences and the chromosome as target DNA template.

Subsequently, the denatured probes with or without purified repetitive DNA (i.e., $C_0t$ 1) were mixed with 1 V prewarmed hybridization solution (comprised of 4×SSC/2 mg/ml nuclease free bovine serum albumin/20% dextran sulfate/30% sterile deionized water) and overlaid onto denatured target DNA. The chromosomal target DNA, fixed to a microscope slide had been denatured at 72° C. for 2 minutes in 50% formamide/2×SSC. A coverslip was placed over the probe hybridization mixture on the slide, sealed with nail polish enamel to prevent evaporation and placed in a moist chamber at 39° C. overnight.

Figure 2:

Following hybridization, non-specifically bound probe was washed off with varying stringencies of salt concentration and temperature. The labeled probes, pre-reacted to disable repetitive sequence hybridization, and the probes without such pre-reaction were detected with rhodamine-labeled antibody to digoxigenin-11-dUTP, using a conventional FISH protocol (Knoll and Lichter, Current Protocol in Human Genetics, Vol. 1, Unit 4.3, Green-Wiley, New York, 1994). Chromosomal DNA was counter-stained with DAPI. The cell preparations on microscope slides were then mounted in antifade solution (such as Vectashield, Vector Laboratories, Burlingame, Calif.) and visually examined using a fluorescence microscope with the appropriate fluorochrome filter sets. FIGS. 1 and 2 are photographs illustrating the results of the comparative hybridizations, where FIG. 1 is the hybridization with the blocking repetitive sequences, while FIG. 2 is the hybridization without pre-reaction with purified repetitive DNA. These photographs depict hybridization to both HIRA alleles on two normal chromosome 22q11.2 regions. A comparison of the photographs demonstrates that the presence of the blocking repetitive sequences is unnecessary using the probes of the present invention.

Figure 6:
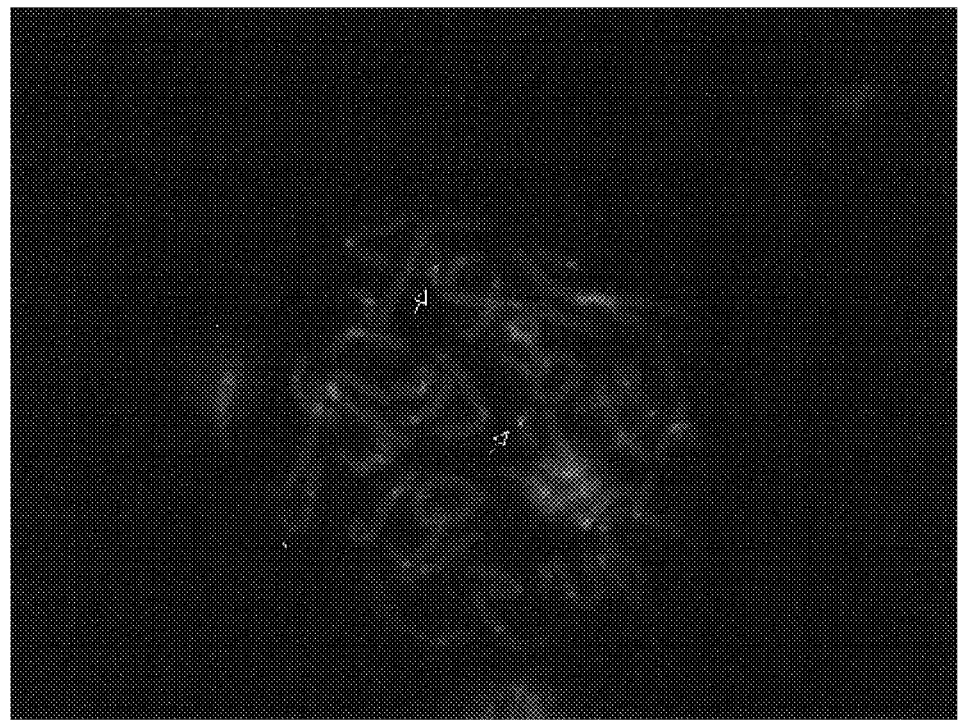
Figure 12:
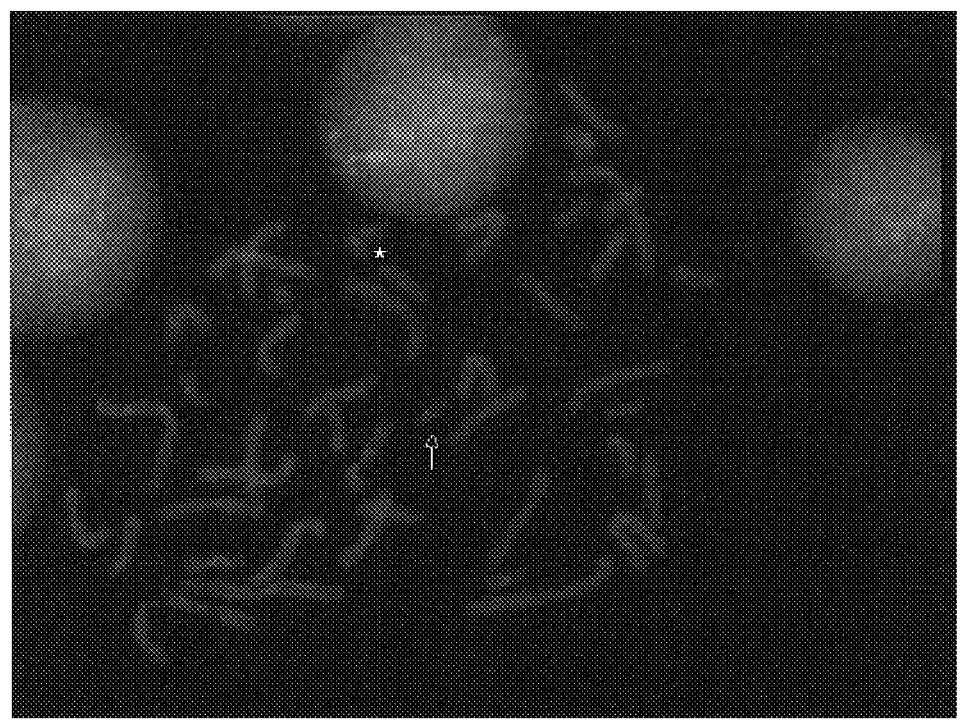

The remaining three probes identified in Table 2 were PCR-amplified and labeled as described above. These probes were used in a series of FISH experiments to determine the efficacy of the probes. Thus, all four probes were used together without pre-annealing of potentially repetitive sequences (FIG. 6), and a combination of the three shortest probes were used on cells from a patient affected with DiGeorge/VCFS with a previously confirmed deletion (FIG. 12). In the FIG. 6 photograph, the probe was hybridized to a single region of both chromosome 22s in a normal individual (arrows) In FIG. 12, only one chromosome 22 hybridized (arrow). The other chromosome 22, as indicated by a star, has a deletion of this region and does not hybridize to the probe.

EXAMPLE 2

Development of NECDIN and CDC2L1 Gene Probes

Figure 7:
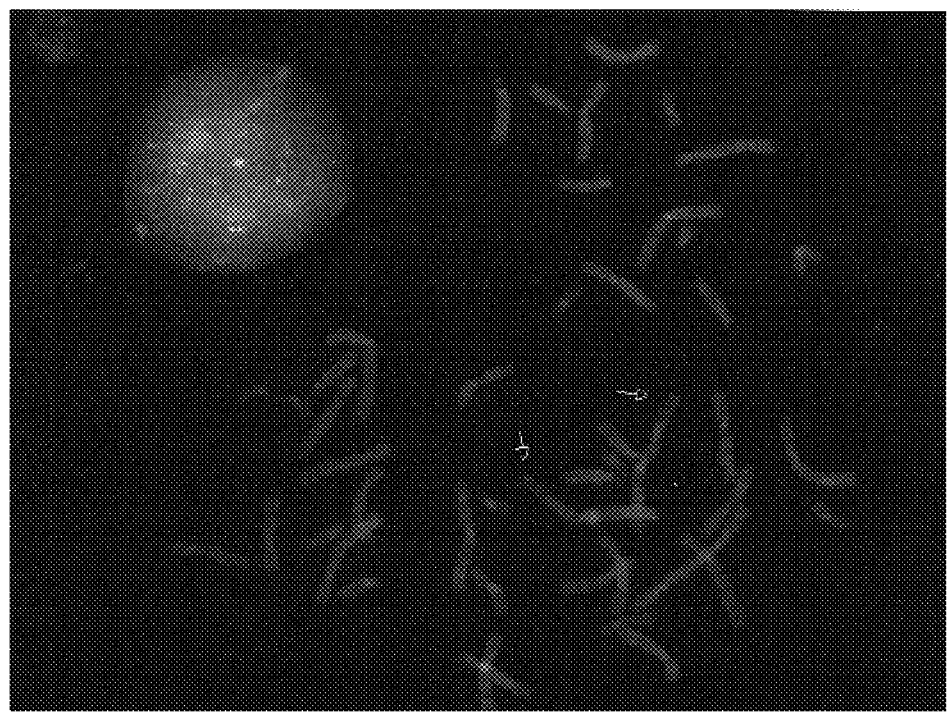
Figure 8:
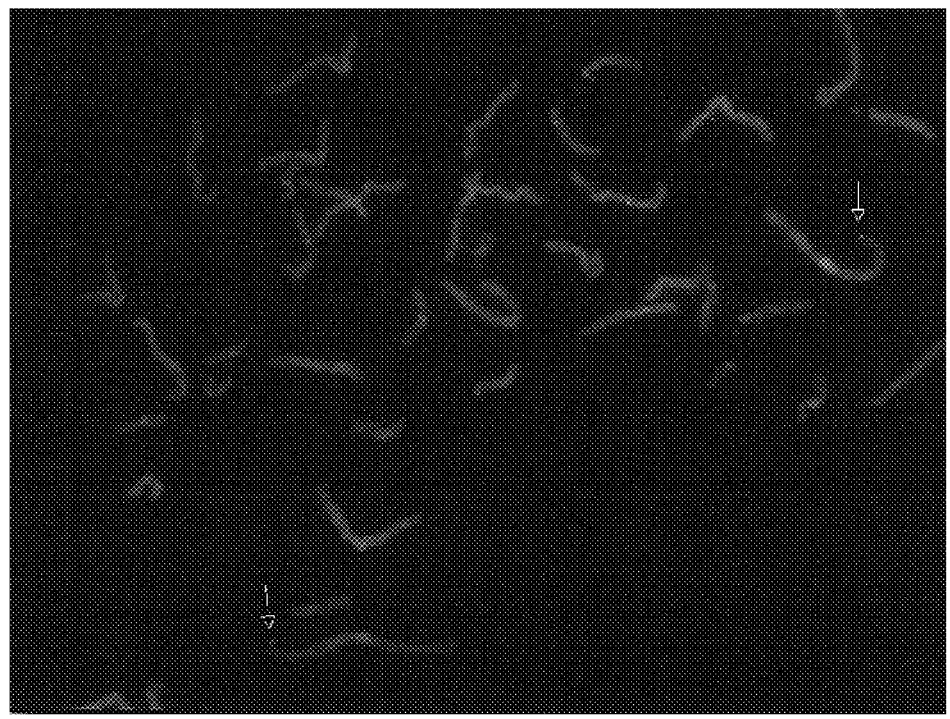
Figure 9:
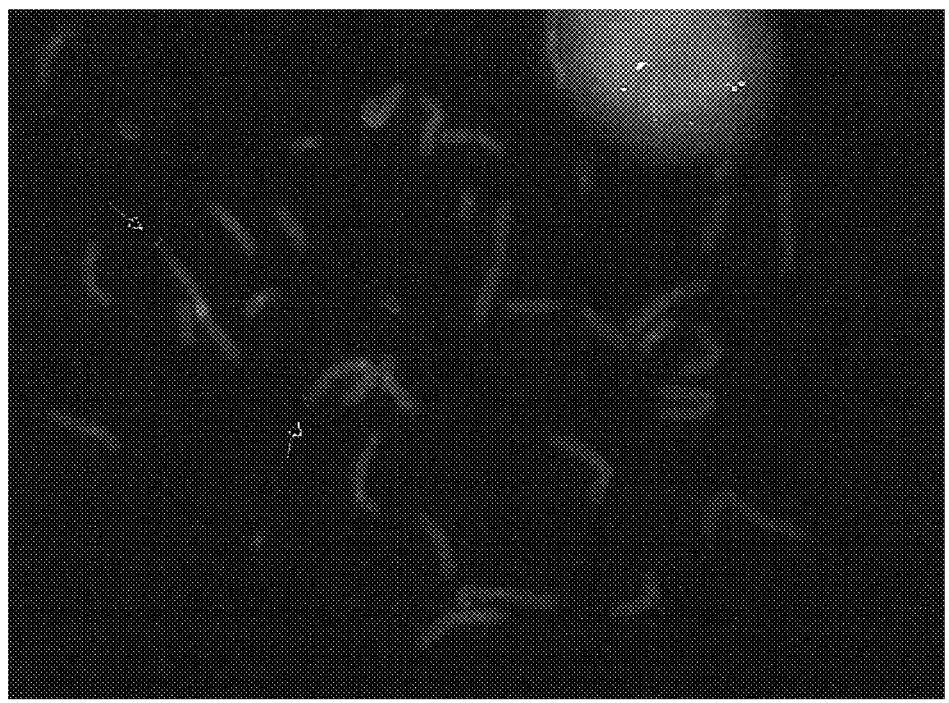
Figure 10:
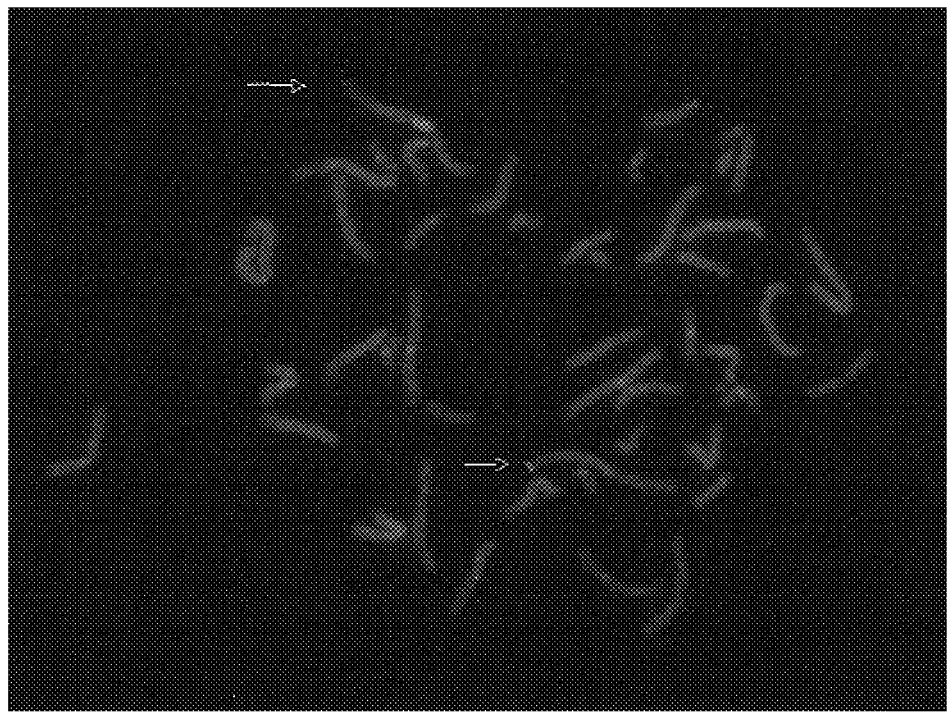

The techniques described in Example 1 were used to develop a series of probes for detecting known genetic disorders on chromosome 1 (Monosomy 1p36.3 syndrome; Slavotinek et al., *J. Med. Genet.*, 36:657–63 (1999)) and on chromosome 15 (Prader-Willi and Angelman Syndromes). Approximately 70% of patients with Prader-Willi or Angelman syndrome exhibit hemizygous deletions of the sequence containing the NECDIN gene (Knoll et al., *Amer. J. Med. Genet.*, 32:285–290 (1989); Nicholls et al., *Amer. J Med. Genet.*, 33:66–77 (1989)). The presence of excess copies of this gene is diagnostic for an abnormal phenotype in patients with interstitial duplication or a supernumerary derivative or dicentric chromosome 15 (Cheng et al., *Amer. J. Hum. Genet.*, 55:753–759, (1994); Repetto et al.,*Am. J. Med. Genet.*, 79:82–89, (1998)). The following Table 3 sets forth the deduced single copy intervals, PCR primer coordinates, SEQ ID Nos., and the lengths of the resultant probes.

ment shown in FIG. 7, the longest 4823 bp probe was employed and potential hybridization repetitive sequences was disabled by pre-annealing with purified repetitive DNA. As a comparison, the same probe was used without pre-annealing of purified repetitive DNA (FIG. 8). The hybridizations appear identical demonstrating that the presence of purified repetitive DNA to block repetitive sequence hybridization is unnecessary. In both instances, the chromosomes with one or both chromatids hybridized are indicated by arrows. In the experiments shown in FIGS. 9 and 10, the 4823 bp and 4724 bp probes were employed, with (FIG. 9) and without (FIG. 10) pre-annealing of the purified repetitive DNA. Again, pre-reaction of the purified repetitive DNA is shown to be unnecessary using the probes of the invention.

Figure 3:
Figure 4:
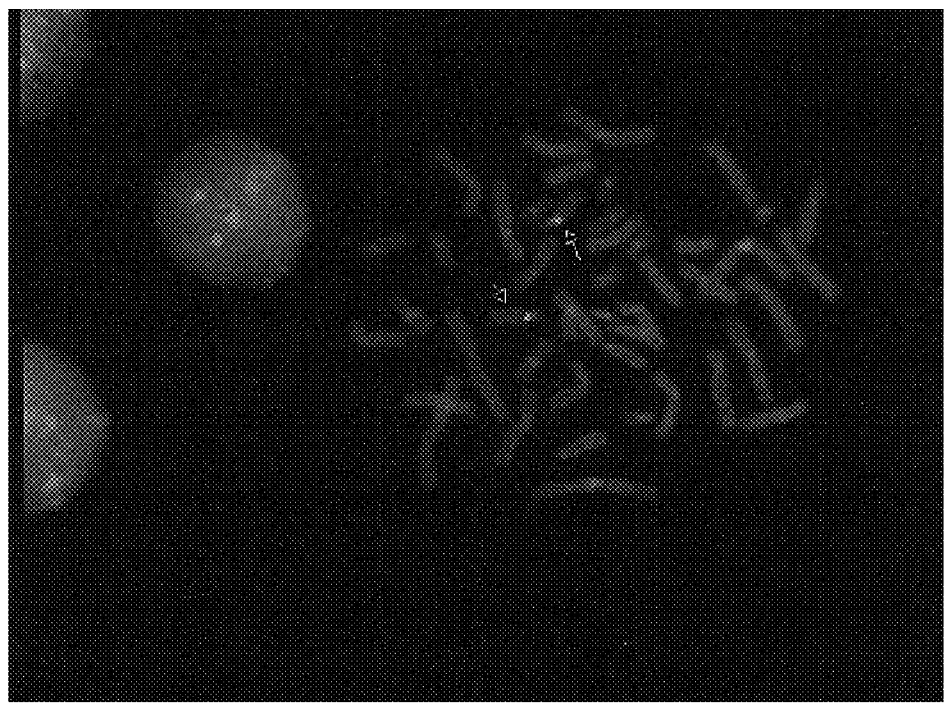
Figure 5:
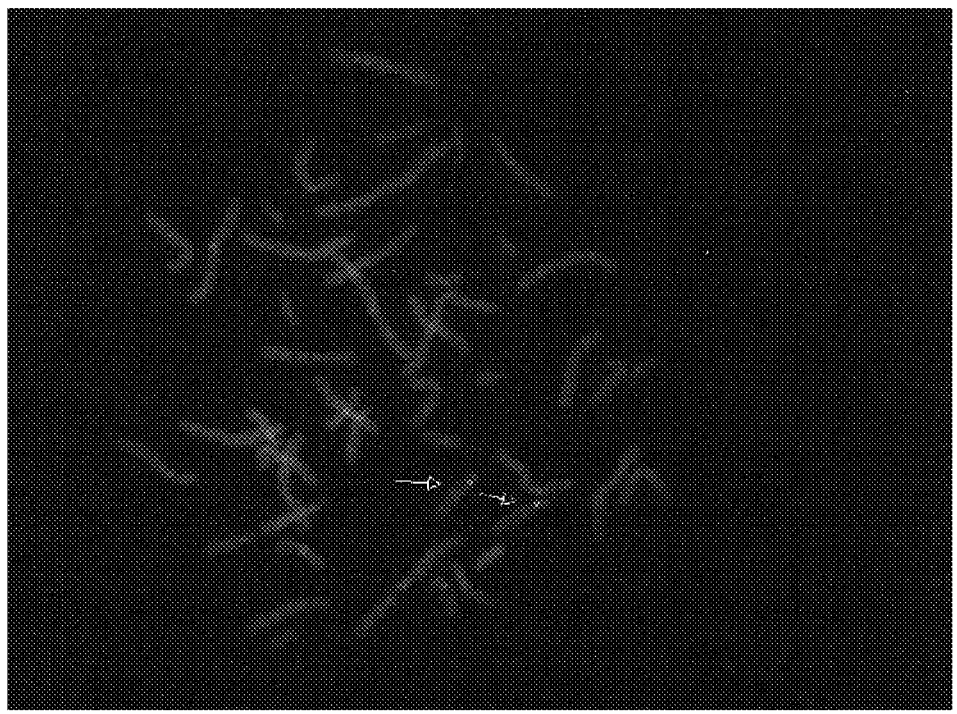
Figure 11:
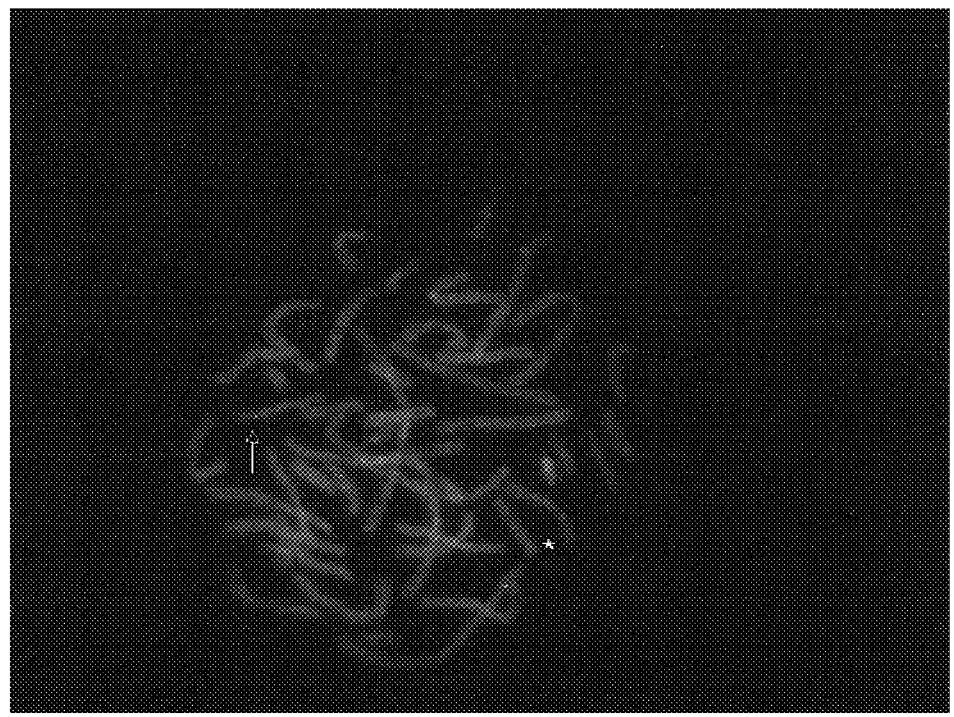

The NECDIN probes were also used in a series of FISH experiments, as shown in FIGS. 3–5 and 11. These probes detected DNA sequences between 36 and 62 kb distal of the NECDIN gene. The 3544 bp probe (SEQ ID Nos. 437–438) detected the 3' terminus of the MAGEL2 gene. In FIG. 3, the 3544 bp probe was used on metaphase cells from a normal individual, with pre-annealing using purified repetitive sequences; FIG. 4 is a comparison, without pre-annealing. In FIG. 11, all three probes were used in combination, on metaphase cells from a patient affected with Prader-Willi syndrome known to harbor a deletion of 15q11-q13 sequences on one chromosome 15. The normal homolog is indicated by an arrow and shows hybridization to a single chromatid. The location of the deleted chromosome is indicated by a star. It does not show hybridization with the probe.

The foregoing examples demonstrate that the mixed combinations of DNA fragments give identical hybridization results, as compared with the fragments when used individually. This establishes that none of the fragments used individually or in combination will hybridize to any other location in the genome and hence, are free of repetitive sequences. This provides an additional confirmation of the validity of the present method for the design and production of single copy genomic probes.

Current use of commercial and research genomic probes to detect these disorders requires that hybridization of repetitive sequences be disabled prior to annealing of the probe to metaphase or interphase chromosomes. This increases the number of steps required to perform the protocol and could potentially increase the chances of procedural errors occurring, any of which would be unacceptable in the

TABLE 3

| Gene | Chromosome Band | GenBank Accession No., Chromosome Genomic Sequence | Coordinates of Longest Single Copy Intervals, Beginning/End | Forward PCR Primer Coordinates, Beginning/End | Reverse PCR Primer Coordinates, Beginning/End | PCR Primer SEQ ID Nos., Forward/Reverse | Probe Length (bp) |
|---|---|---|---|---|---|---|---|
| CDC2L1[1] | 1p36.3 | AL031282 | 8823/17757 | 9137/9167 | 13960/13931 | 444/443 | 4823 |
| CDC2L1[1] | 1p36.3 | AL031282 | 8823/17757 | 13028/13057 | 17752/17720 | 445/446 | 4724 |
| NECDIN | 15q11–q13 | AC006596 | 94498/99152 | 94501/94535 | 98567/98601 | 439/440 | 4166 |
| NECDIN | 15q11–q13 | AC006596 | 68031/75948 | 72122/72156 | 75666/75637 | 437/438 | 3544 |
| NECDIN | 15q11–q13 | AC006596 | 76249/79221 | 76608/76639 | 78898/78867 | 441/442 | 2290 |

[1]Two sets of primers were used to generate two DNA probe fragments which, together, spanned the entire interval.

PCR-amplification was performed using the CDC2L1 primers in Table 3, and products were labeled, hybridized and detected as set forth in Example 1. The labeled probes were used in a series of FISH experiments, with images of the hybridizations provided as FIGS. 7–10. In the expericlinical diagnostic laboratory. The results present in FIG. 7 are comparable to those obtained using related commercially available genomic probes to detect these abnormalities. Hence, these probes will be useful in the detection of these genetic disorders. The probes themselves or in combination with other solutions necessary for hybridization and detections can be provided to clinical laboratories as kits for detection of these genetic disorders.

The probes developed from genomic sequences other than those presented as examples cited herein can also be utilized to detect inherited, sporadic, or acquired chromosomal rearrangements. These rearrangements may correspond to numerous other known genetic abnormalities (including neoplasias) and syndromes besides those examples given above. Hence, the present invention can also be useful for producing probes from genomic regions where no commercial probes are available or the probes are imprecise.

In principle, the present method can be utilized to design, develop and produce single-copy genomic probes for any genomic interval where the DNA sequence is available and where a comprehensive set of repetitive sequence elements in the genome has been cataloged. Such catalogs are currently available for genomes for the following organisms (girinst.org): *Homo sapiens, Mus musculus, Arabidopsis thaliana, Canorhabditis elegans. Drosophila melanogaster,* and *Danio rerio.*

EXAMPLE 3

In this example, a number of probes specific to additional genetic disorders and cytogenetic abnormalities were developed using the principles of the invention. Software was also developed and improved to expedite the process of designing single copy probes (findi.pl, prim_wkg, and prim, referred to above and provided on the accompanying CD-R). The probes were subsequently tested and their utility confirmed by in situ hybridization.

Identification of Single Copy Sequences

The locations of single copy probe sequences are determined directly from long contiguous genomic DNA sequences. The locations were determined by software that aligns the sequences of repetitive sequence family members with the target genomic sequence. Comparison of the target sequence with previously determined sequences of repetitive family members served to identify and delineate the bounds of repetitive elements within the target. The computer program, RepeatMasker (genome.washing-ton.edu/RM/RepeatMasker.html); Smit A. F. A. & Green P., unpublished results), was used to determine the locations of repetitive sequence families in contiguous genomic sequences, usually ~100 kb in length. RepeatMasker compares a genomic sequence with a compilation of repetitive sequence families present in multiple copies in the human genome. This repeat sequence database contains representative and consensus sequences for the majority of human repetitive sequence families. The database can be expanded by addition of newly discovered repetitive sequence families (as shown in Example 6).

A Perl script (findi.pl) parsed the coordinates of the boundaries of the repetitive segments from RepeatMasker output, and then deduced and sorted the adjacent single copy intervals by size greater than a parametrized threshold (~2 kb, in most instances). This script determines the locations and lengths of single copy intervals sorted by size from the output file (with the suffix: out) produced by RepeatMasker, which contains a table of locations and lengths of repeat family elements. The boundaries of adjacent single copy intervals were deduced by subtracting one nucleotide position from the upstream boundary of a repetitive element and adding one nucleotide position to the downstream boundary of the previous element. Single copy intervals with identical upstream and downstream coordinates (1 bp in length) were considered to be adjacent repetitive sequences. Probe sequences were then compared with the human genome sequence database (Altschul et al., *J. Mol. Biol.,* 215:403–410 (1990)) to determine if there was similarity to sequences elsewhere in the genome (such as duplicons or triplicons or other less well conserved intervals). Probe sequences that are weakly conserved elsewhere in the genome do not cross-hybridize to those targets.

Oligonucleotide primers were selected for PCR amplification of the longest single copy intervals. A Unix wrapper script (prim_wkg) iteratively modifies the switches in the file containing the command to design primers (prim), thus optimizing primer selection by changing the following parameters for input to the program, Prime (Genetics Computer Group; Madison, Wis.): $T_m$ (from 70–60° C.), G/C composition (from 55–40%), and minimum interval length (from 90%–80% of the length of the single copy interval).

Probe Generation and Chromosomal in Situ Hybridization

DNA fragments were amplified by long PCR (Cheng et al., *Proc. Natl. Acad. Sci. U.S.A.,* 91:5695–5699 (1994)) with LA-Taq as recommended by the manufacturer (Panvera, Madison, Wis.). Other enzymes for long PCR have been demonstrated to produce comparable results, including those manufactured by Roche Molecular Biochemicals, Indianapolis, Ind.; Stratagene, LaJolla, Calif.; and Invitrogen, Carlsbad, Calif. The amplicons were purified by low-melt temperature agarose gel electrophoresis, followed by chromatography with Micro-con 100 columns (Millipore, Bedford Mass.), which removed contaminating extension products containing repetitive sequences.

Probe fragments were labeled by nick translation using modified nucleotides such as digoxigenin-dUTP or biotin-dUTP (Roche Molecular Biochemicals, Indianapolis, Ind.). Labeled probes were denatured and hybridized to fixed chromosomal preparations on microscope slides using previously described conditions (Knoll and Lichter, *Current Protocols in Human Genetics,* Vol. 1, Unit 4.3, Green-Wiley, New York (1994)), with the exception that preannealing of the probe(s) with repetitive DNA (such as $C_0t1$ DNA) was not utilized in a parallel set of hybridizations. Probes from a single chromosome region of ~100 kb were hybridized individually or in combination to remove non-specific binding. Post-hybridization washes were performed at 42° C. in 50% formamide in 2×SSC, followed by an additional wash at 39° C. 2×SSC and one in 1×SSC at room temperature. Wash stringency was increased, if necessary, to remove hybridization of probes to related sequences elsewhere in the genome. Hybridized probes were detected with a fluorochrome (such as rhodamine or fluorescein) tagged antibody to the modified nucleotide. Chromosome identification was performed by counterstaining the cellular DNA with 4',6-diamidino-2-phenylindole (DAPI). Hybridized chromosomes were viewed with an epifluorescence microscope (Olympus, Melville, N.Y.) equipped with a motorized multi-excitation fluorochrome filter wheel. Hybridization patterns on at least 20 metaphases (and 50–100 nuclei) were scored for each probe or combination of probes, with and without preannealing to $C_0t1$ DNA. Cells were imaged using a CCD camera (Cohu, Inc, San Diego, Calif.) and CytoVision ChromoFluor software (Applied Imaging, Santa Clara, Calif.).

Table 4 sets forth the data generated using the foregoing procedure, with respect to a number of probes specific to known disorders and cytogenetic abnormalities. The abnormality designation makes use of standardized nomenclature as set forth in ISCN 1995, An International System for Human Cytogenetic Nomenclature (1995), Mittelman F, ed.

TABLE 4

| Disorder | Representative Cytogenetic Abnormality Detected by Probes on Metaphase Chromosomes | Gene or Transcript | Interval |
|---|---|---|---|
| Angelman Syndrome and Prader-Willi Syndrome | ish del(15)(q11.2q11.2)(UBE3A−) | UBE3A | IVS 8–IVS 9 |
| | ish del(15)(q11.2q11.2)(IC/SNRPN−) | IC/SNRPN | IVS 3' to Exon u1B* |
| Duplication 15 Syndromes | ish dup(15)(q11.2q13)(UBE3A++, IC/SNRPN++) and ish dic(15q11.2q13) (UBE3A++, IC/SNRPN++) | IC/SNRPN | IVS 5'–Exon u1B[1]–IVS 3' |
| | | IC/SNRPN | IVS 5'–Exon u1B |
| Kallmann Syndrome | ish del(X)(p22.3)(KAL1−) | KAL1 | ~53 kb downstream |
| | | KAL1 | IVS 10 |
| Turner Syndrome and Distal Xp Deletions | ish del(X)(p22.3)(SHOX−) | SHOX | IVS 1–Exon 2 |
| | | SHOX | IVS 2 |
| | | SHOX | IVS 3 |
| | ish del(X)(p22.3)(GS2−) | GS2 | Promoter–IVS 2 |
| | ish del(X)(p22.3)(TBL1−) | TBL1 | IVS 2 |
| | | TBL1 | 3' UTR |
| Down Syndrome | ish(21)(q22.2q22.3)(DSCR4 × 3) | DSCR4[2] | ~39 kb upstream |
| | | DSCR4[2] | ~30 kb upstream |
| | | DSCR4[2] | ~20 kb upstream |
| Chronic Myelogenous Leukemia and Acute Lymphoblastic Leukemia | ish t(9; 22)(q34; q11.2)(BCR st) | BCR | Proximal to the major breakpoint in CML |
| | | BCR | Proximal to the major breakpoint in CML |
| | | BCR | IVS 8 |
| | ish t(9; 22)(q34; q11.2)(ABL st) | ABL1 | Exon 1B–IVS 1B |
| | | ABL1[3] | IVS 1B |
| | ish t(9; 22)(q34; q11.2)(ABL mv) | ABL1 | IVS 4–IVS 6 |
| | | ABL1 | Exon 11–IVS 11 |
| | ish t(9; 22)(q34; q11.2)(ABL mv) | ABL1 | IVS 3 |
| | | ABL1[3] | IVS 3 |
| | | ABL1 | IVS 3 |
| | | ABL1 | IVS 4–IVS 6 |
| Williams Syndrome | ish del(7)(q11.23q11.23)(LIMK1−) | LIMK1 | IVS 13–3'UTR |
| | | LIMK1 | IVS2 |
| Acute Myelogenous Leukemia-Type M4 | ish inv(16)(p13q22)(PM5 sp) | PM5[2,4] | ~20 kb downstream |
| | | PM5[2,4] | ~60 kb downstream |
| | ish inv(16)(p13q22)(PLA2G10 mv, PKD mv, PM5 sp) | PLA2G10[4] | IVS 3 |
| | | PKD | IVS 12–Exon 15 |
| | | PM5 | ~100 kb upstream |
| | | PLA2G10[4] | IVS 3 |
| | | PKD | Exon 15–IVS 20 |
| | | PM5 | ~100 kb upstream & ~300 kb downstream |
| | ish inv(16)(p13q22)(ABCC1st) | ABCC1 | IVS 6 |
| Rubinstein-Taybi Syndrome | ish del(16)(p13.3)(CREBBP−) | CREBBP | IVS 18 |
| Acute Lymphocytic Leukemia | ish t(12; 21)(p13.2; q22.1)(AML1 st) | AML1 | IVS 1–IVS 2 |
| | ish t(12; 21)(p13.2; q22.1)(TEL/ETV6 mv) | TEL/ETV6 | IVS 4 |
| | | TEL/ETV6 | IVS 3 |
| | | TEL/ETV6 | IVS 2 |
| Cri-du-Chat Syndrome | ish del(5)(p15.3)(CTNND2−) | CTNND2 | IVS 17 |
| | | CTNND2 | IVS 14 |
| | ish del(5)(p15.3)(SEMA5A−) | SEMA5A | IVS 3 |
| | | SEMA5A | IVS 3 |
| | | SEMA5A | IVS 3 |
| | ish del(5)(p15.3)(SLC6A3−) | SLC6A3 | IVS 3 |
| Langer-Giedeon Syndrome | ish del(8)(q23.3q24.1)(TRPS1−) | TRPS1 | IVS 1 |
| | | TRPS1 | IVS 1 |
| Smith-Magenis Syndrome | ish del(17)(p11.2p11.2)(ADORA2B−) | ADORA2B[5] | Promoter–IVS 1 |
| | | ADORA2B[5] | IVS 1 |
| | ish del(17)(p11.2p11.2)(FLI1−) | FLI1 | IVS 9–IVS 12 |
| | | FLI1 | IVS 12–IVS 14 |
| | | FLI1 | IVS 15–Exon 21 |
| | ish del(17)(p11.2p11.2)(MFAP4−) | MFAP4 | IVS 2–3' UTR |
| | ish del(17)(p11.2p11.2)(ZNF179/PAIP1/SHMT−) | ZNF179–PAIP1−[3] | Between ZNF179 and PAIP1. |
| | | SHMT1 | IVS 4 |
| | ish del(17)(p11.2p11.2)(LGLL/HUGL−) | LLGL | Promoter–Exon 2 |
| | | HUGL | Promoter–IVS 1 |
| Charcot-Marie-Tooth Disease Type 1A | ish dup(17)(p11.2p11.2)(PMP22++) | PMP22 | Promoter (~5 kb upstream) |
| | | PMP22 | ~22 kb downstream |
| | | PMP22[5] | IVS 3 |
| | | PMP22 | IVS 3 |

TABLE 4-continued

| Miller-Dieker Syndrome | ish del(17)(p13.3)(PAFAHIB1/EIF-3−) | PAFAHIB1 EIF-3[6] | ~5 kb downstream IVS 24–IVS 27 |
| --- | --- | --- | --- |
| | | PAFAHIB1 EIF-3 | ~7–8 kb downstream IVS 15–IVS 19 |
| | | PAFAHIB1 EIF-3 | ~13 kb downstream IVS 5–IVS 11 |
| Alagille Syndrome | ish del(20)(p12.3p12.3)(JAG1−) | JAG1 | IVS 5–IVS 8 |
| | | JAG1 | IVS 2–IVS 3 |
| | | JAG1 | Exon 1–IVS 2 |
| Monosomy 13q32 | ish del(13)(q32.3)(ZIC2−) | ZIC2 | ~5.8 kb downstream |
| Trisomy 13 | ish(13)(q32.3)(ZIC2 × 3) | ZIC2 | ~2 kb upstream |
| Wolf-Hirschom Syndrome | ish del(4)(p16.3)(HD−) | HD | Exon 67 |

| Disorder | GenBank Accession No. | Forward PCR Primer Coordinate, Beginning/End | Reverse PCR Primer Coordinate, Beginning/End | Sequence ID Forward/ Reverse Primers |
| --- | --- | --- | --- | --- |
| Angelman Syndrome and Prader-Willi Syndrome | AC004600 | 41085/41119 | 45354/45325 | 480/481 |
| | AC004737 | 13740/13769 | 15414/15387 | 482/483 |
| Duplication 15 Syndromes | AC004737 | 31102/31128 | 33347/33323 | 484/485 |
| | AC004737 | 47792/47821 | 49470/49441 | 486/487 |
| Kallmann Syndrome | AC006062 | 104433/104465 | 107097/107072 | 488/489 |
| | AC006062 | 38822/38852 | 42042/42012 | 490/491 |
| Turner Syndrome and Distal Xp Deletions | NT_001151 | 44615/44646 | 47505/47473 | 492/493 |
| | NT_001151 | 49637/49669 | 52251/52217 | 494/495 |
| | NT_001151 | 54357/54387 | 56821/56791 | 496/497 |
| | NT_001457 | 78970/79000 | 82994/82960 | 498/499 |
| | NT_001159 | 175379/175409 | 179665/179633 | 500/501 |
| | NT_001159 | 247264/247293 | 251290/251257 | 502/503 |
| Down Syndrome | AP000160 | 31007/31041 | 32999/32965 | 504/505 |
| | AP000160 | 40725/40754 | 43078/43045 | 506/507 |
| | AP000160 | 49973/50006 | 52409/52376 | 508/509 |
| Chronic Myelogenous Leukemia and Acute Lymphoblastic Leukemia | U07000 | 100745/100776 | 104145/104115 | 510/511 |
| | U07000 | 74699/74728 | 77903/77874 | 512/513 |
| | U07000 | 114946/114978 | 117457/117426 | 514/515 |
| | U07561 | 27182/27213 | 29388/29357 | 516/517 |
| | U07562 | 9193/9222 | 11035/11004 | 518/519 |
| | U07563 | 65951/65985 | 70266/70237 | 520/521 |
| | U07563 | 78862/78891 | 83813/83784 | 522/523 |
| | U07563 | 55807/55836 | 58077/58046 | 524/525 |
| | U07563 | 53570/53604 | 55489/55455 | 526/527 |
| | U07563 | 55854/55888 | 57848/57817 | 528/529 |
| | U07563 | 66333/66367 | 70295/70264 | 530/531 |
| Williams Syndrome | NT_000398 | 59947/59976 | 62211/62187 | 532/533 |
| | NT_000398 | 31966/31993 | 35015/34989 | 534/535 |
| Acute Myelogenous Leukemia-Type M4 | NT_000691 | 24509/24538 | 27988/27958 | 536/537 |
| | NT_000691 | 64204/64233 | 67682/67652 | 538/539 |
| | NT_000691 | 68271/68300 | 71986/71957 | 540/541 |
| | NT_000691 | 71957/71986 | 75481/75452 | 542/543 |
| | NT_025903 | 313783/313812 | 315675/315645 | 544/545 |
| Rubinstein-Taybi Syndrome | NT_000671 | 58833/58862 | 63347/63318 | 546/547 |
| Acute Lymphocytic Leukemia | AP000057 | 98712/98741 | 102903/102872 | 548/549 |
| | NT_000601 | 95456/95480 | 97283/97260 | 550/551 |
| | NT_000601 | 72543/72564 | 74385/74361 | 552/553 |
| | NT_000601 | 38216/38245 | 40091/40062 | 554/555 |
| Cri-du-Chat Syndrome | NT_000149 | 169655/169685 | 171976/171945 | 556/557 |
| | NT_000149 | 199168/199202 | 203507/203473 | 558/559 |
| | NT_000147 | 23905/23935 | 27710/27676 | 560/561 |
| | NT_000147 | 30757/30790 | 33241/33209 | 562/563 |
| | NT_000147 | 14716/14748 | 17787/17753 | 564/565 |
| | AF119117 | 28206/28239 | 31894/31860 | 566/567 |
| Langer-Giedeon Syndrome | NT_002886 | 267731/267760 | 270758/270724 | 568/569 |
| | NT_002886 | 271242/271271 | 274437/274404 | 570/571 |
| Smith-Magenis Syndrome | NT_000770 | 56443/56472 | 58524/58491 | 572/573 |
| | NT_000770 | 77442/77475 | 79222/79189 | 574/575 |
| | U80184 | 6094/6127 | 7300/7267 | 576/577 |
| | U80184 | 7424/7453 | 8742/8708 | 578/579 |
| | U80184 | 9615/9647 | 11738/11704 | 580/581 |
| | NT_000760 | 132621/132654 | 134663/134634 | 582/583 |
| | AL035367 | 9818/9850 | 12272/12241 | 584/585 |
| | AL035367 | 1194/1226 | 5365/5334 | 586/587 |

TABLE 4-continued

| | | | | |
|---|---|---|---|---|
| Charcot-Marie-Tooth | AC005703 | 153173/153202 | 155027/154994 | 588/589 |
| Disease Type | AC005703 | 215632/215661 | 217362/217329 | 590/591 |
| 1A | AC005703 | 184666/184700 | 186035/186006 | 592/593 |
| | AC005703 | 176746/176778 | 179073/179044 | 594/595 |
| Miller-Dieker | NT_000774 | 63645/63679 | 66603/66573 | 596/597 |
| Syndrome | NT_000774 | 68841/68870 | 71195/71163 | 598/599 |
| | NT_000774 | 75328/75362 | 78122/78093 | 600/601 |
| Alagille Syndrome | AL035456.24 | 153935/153966 | 157675/157642 | 602/603 |
| | AL035456.24 | 144875/144904 | 147028/146995 | 604/605 |
| | AL035456.24 | 135644/135673 | 139440/139407 | 606/607 |
| Monosomy 13q32 | AL355338 | 111114/111145 | 116046/116012 | 608/609 |
| Trisomy 13 | AL355338 | 128595/128627 | 133039/133006 | 610/611 |
| Wolf-Hirschom Syndrome | NT_000102 | 267614/267643 | 271120/271091 | 612/613 |

[1]u1B is ~160 kb upstream from the PWS shortest region of overlap and ~85 kb upstream from the AS shortest region of overlap.
[2]Probe also cross-hybridizes to a sequence found on the p arm of acrocentric chromosomes. Probe sequence is not found in public repetitive sequence database.
[3]Probe also cross-hybridizes to an interspersed repetitive sequence family that is not found in the public repetitive sequence database.
[4]PM5 is ~1.3 mb telomeric of MYH11 gene, which is disrupted at the inv(16p) breakpoint. PLA2G10 is ~200 kb telomeric of PM5.
[5]Probe was hybridized in combination with other probes and not individually.
[6]Probe is downstream and adjacent to PAFAHIB1 gene (formerly known as LIS1). An expressed transcript homologous to EIF-3 is found at these coordinates.

EXAMPLE 4

In this example, a more precise chromosomal breakpoint determination was made using the probes of the invention. Structural chromosome rearrangements can be inherited in genetic disease or acquired as in the case of certain cancers. They can occur within a single chromosome (such as an inversion, deletion or duplication) or between homologous or non-homologous chromosomes (i.e. translocations). With the probes of the invention, the precise region of breakage can be determined at a previously unprecedented level of resolution. Such resolution permits detection of genes or sequences that are disrupted in the formation of the rearrangement and may provide insight into etiology, prognosis and/or treatment. In inherited contiguous gene syndromes, precise localization of chromosome breakpoints can define the extent of deletion or duplication and hence the prognosis of the disorder (Cheng et al., Am. J. Hum. Genet., 55:753–759 (1994)).

The following example illustrates how the single copy probes hereof provide more precise information than commercially available cloned probes for the same chromosomal region.

In most cases of chronic adult myeloid leukemia (CML; 90%) and in some cases of acute lymphoblastic leukemia (ALL; 25–30% adults; 2–10% children) (Perkins et al., Cancer Genet. Cytogenet., 96(1): 64–80 (1997); Rubintz et al., J. Pediatr. Hematol. Oncol, 20 (1):1–11(1998)), a reciprocal translocation between chromosome 9q34 and 22q11.2 is evident (Rowley, Nature, 243:290–392 (1973)). The abnormal or derivative chromosome 22 that results from this translocation fuses the ABL1 oncogene on chromosome 9 to the BCR (breakage cluster region) promoter on chromosome 22. The ABL1 oncogene is expressed as either a 6 or a 7 kb mRNA transcript with alternatively spliced first exons, exons 1b and 1a respectively, spliced to the common exons 2–11. Exon 1b is ~250 kb proximal of exon 1a and this very long intron is a primary target for translocations. In CML, the ABL1 gene is translocated from chromosome 9 to the promoter of the BCR gene on chromosome 22 to produce a chimeric BCR-ABL1 protein (Bernards, et al., Mol. Cell. Biol., 7:3231–3236; (1987). The BCR gene contains 24 exons and encodes a 160 kD protein. The BCR breakpoints differ in CML and ALL. In CML, most breakpoints occur within the 5.8 kb major breakpoint cluster region (M-BCR) which corresponds to exons 12 through 17 (or b1 through b5); whereas in most ALL, the BCR gene breaks between exons 1 and 2 (minor or m-BCR). Thus different molecular rearrangements resulting in differently-sized proteins occur in each disorder. These rearrangements can be distinguished with the probes of the invention.

At the DNA level, dual color-dual probe fluorescence in situ hybridization (FISH) strategies are available to detect the BCR-ABL1 translocation on metaphase chromosomes and interphase nuclei (Bentz et al., Blood, 83:1922–1928 (1994); Sinclair et al., Blood, 90:1395–1402 (1997); Buno et al., Blood, 92:2315–2321 (1998)). With conventional FISH, the initial strategy was to have the probe for the ABL1 oncogene region (distal of the breakpoint and ~200kb in size) detected in one color (i.e., red) and the BCR region (proximal of the breakpoint) in another color (i.e., green). Thus, in derivative chromosome 22 positive cells, one red and one green signal co-localized to give a yellow hybridization signal indicating the presence of a derivative 22 chromosome while the normal chromosome 9 and chromosome 22 remained as independent red and green signals. More recently, larger cloned DNA probes that span both sides of the ABL1 translocation breakpoint have been utilized for detecting translocations. In this strategy, the part of the probe that is proximal to the breakpoint remains on the abnormal chromosome 9 and the part distal to the breakpoint co-localizes with BCR as in the previous strategy. This results in an extra signal (ES) on the translocated chromosome 9 and is the strategy behind the BCR-ABL1 ES dual-color translocation probe (Vysis, Inc., Downers Grove, Ill.) that many clinical cytogenetics laboratories use (Herens et al., Br. J. Haem., 110(1):214–216 (2000); Sinclair et al, Blood, 95(3):738–744 (2000)). In the ES system, the ABL1 probe cocktail spans a genomic target significantly larger than the ABL1 gene. This cocktail extends from arginosuccinate synthetase gene (ASS), which is ~250 kb upstream from ABL1, through the ABL1 gene and several kb downstream.

Figure 13:
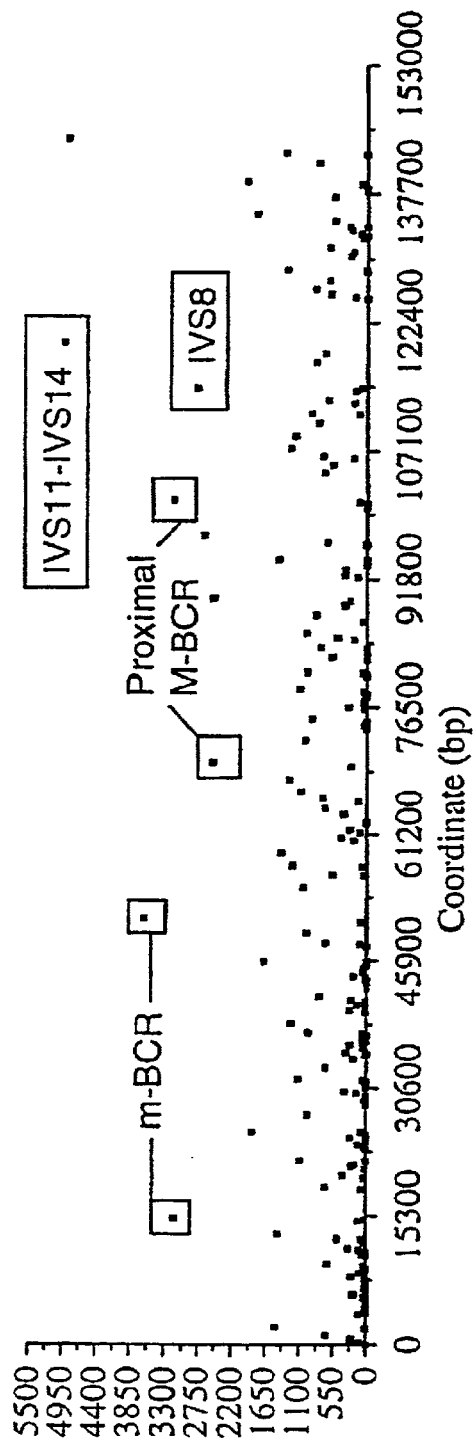
FIG. 13 is a scatterplot of base pair coordinates versus single copy probe lengths found in the Breakage Cluster Region gene (BCR) promoter found on chromosome 22, the disruption of which is common in cases of chronic adult myeloid leukemia and in some cases of acute lymphoblastic leukemia, as described in Example 4.
Figure 14:
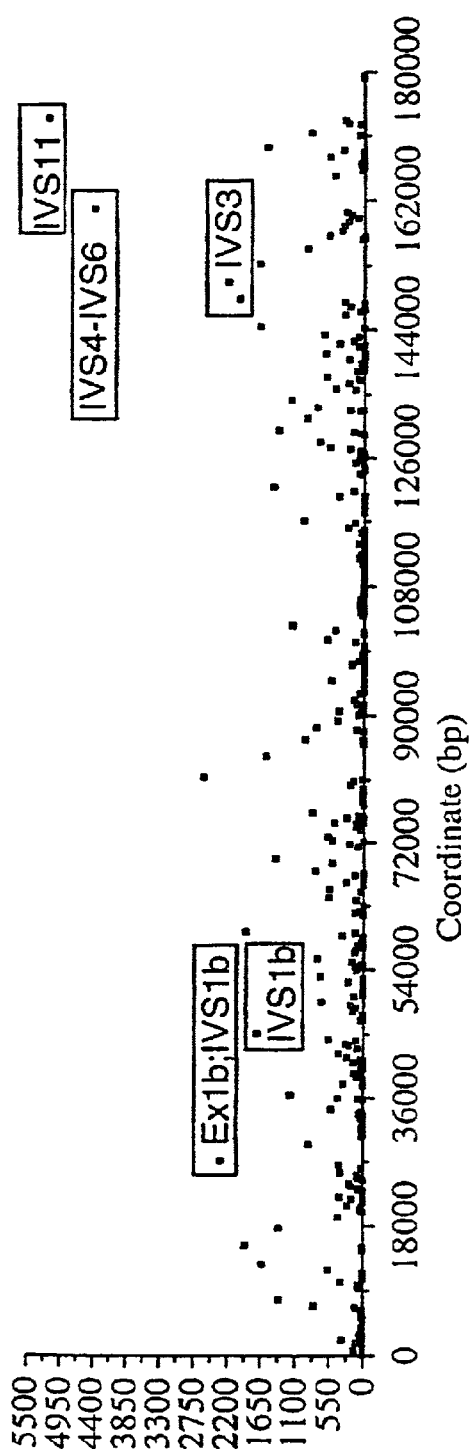
FIG. 14 is a scatterplot of base pair coordinates versus single copy probe lengths found in the ABL1 gene on chromosome 9, the disruption of which is common in cases of chronic adult myeloid leukemia and in some cases of acute lymphoblastic leukemia, as described in Example 4.

Several single copy probes were designed for ABL1 and BCR by identifying the boundaries of single copy intervals at these loci. FIGS. 13 and 14 indicate the locations of potential single copy probes within the BCR and ABL1 loci, respectively. Eleven intervals exceeding 2 kb length are distributed throughout the BCR gene, 5 of which have been currently designed as probes. A similar number of additional shorter single copy regions in this gene (between 1.5 and 2.0 kb) could be combined to more precisely delineate translocation breakpoints. In the ABL1 gene, 10 intervals >2 kb are found, six of which have been designed as probes.

Multiple single copy probes for both BCR (FIG. 13) and ABL1 (FIG. 14) have been deduced and oligonucleotide primer sets derived. For BCR, these probes discriminate between the minor (FIG. 13) and major breakpoints (FIG. 13 and SEQ ID Nos. 510–515). Conventional FISH testing with BCR-ABL1 ES probe does not distinguish between rearrangements at the major (M) and minor (m) breakpoints in the BCR gene. A mixture of m-BCR probes detects the minor breakpoint often seen in patients with ALL, and those designated M-BCR (SEQ ID Nos. 510–515) detect the major breakpoint evident in most patients with CML. If all of the probes translocate to the chromosome 9, then the gene is interrupted at the minor breakpoint. If only the M-BCR probes translocate from chromosome 22 to the derivative chromosome 9 and the m-BCR probes remain on the derivative chromosome 22, then the gene is interrupted at the major breakpoint.

Figure 15:
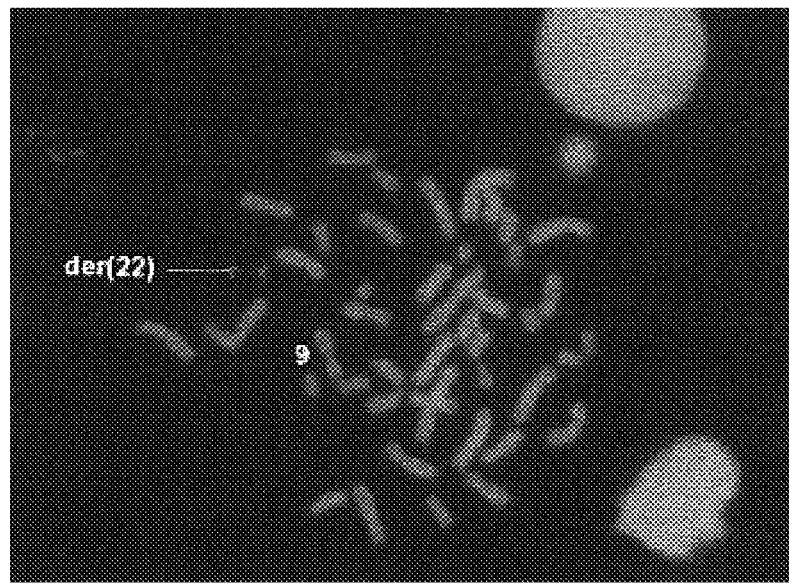
FIG. 15 is a CCD camera image of a FISH experiment using chromosome 9q34-specific, digoxigenin-dUTP labeled probes from the ABL1 oncogene (SEQ ID Nos. 520–525), and detected with rhodamine (red) conjugated antibody to digoxigenin with DAPI stained metaphase cells from a patient with chronic myelogenous leukemia (CML), illustrating the use of probes downstream of the site of fusion between ABL1 gene and BCR gene used to make a precise chromosomal breakpoint determination as explained in Example 4 wherein the derivative chromosome 22 and normal chromosome 9 are indicated.
Figure 16:
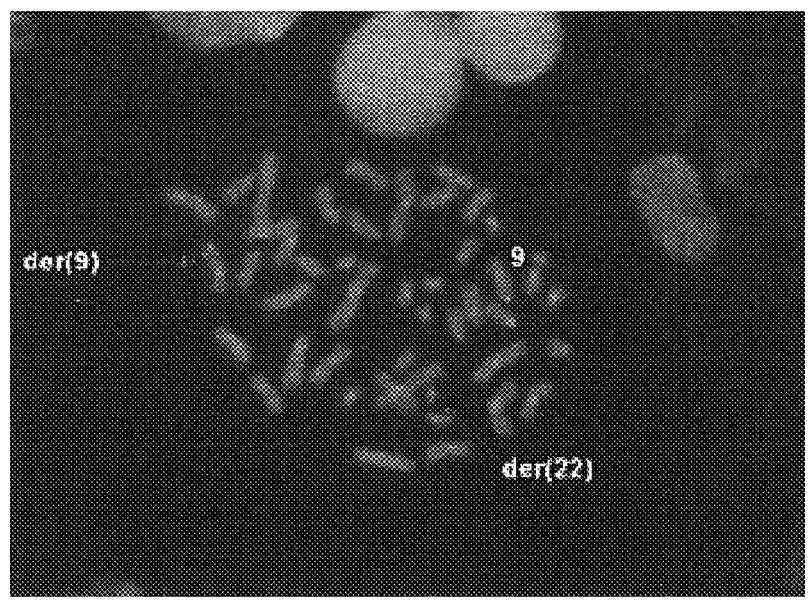
FIG. 16 is a CCD camera image of a FISH experiment using chromosome 9q34-specific, digoxigenin-dUTP labeled probes from the ABL1 oncogene (SEQ ID Nos. 516–525) and detected with rhodamine (red) conjugated antibody to digoxigenin, with DAPI stained metaphase cells from a patient with CML, illustrating the use of probes from each side of the site of fusion between BCR and ABL1 genes used to make a precise chromosomal 9q34 breakpoint determination as explained in Example 4, wherein the derivative chromosome 22, derivative chromosome 9 and normal chromosome 9 are indicated.

For ABL1, two of the probes are predicted to be proximal of the breakpoint (SEQ ID Nos. 516/517 and 518/519), and the others are distal to the breakpoint (SEQ ID Nos. 520 through 531). Hybridization of three ABL1 probes distal to the breakpoint in CML shows that the probes have moved to the derivative chromosome 22 (FIG. 15), whereas a combination of five ABL1 probes that span the breakage interval demonstrates that some probes remain on the derivative chromosome 9 while others move to the derivative chromosome 22 (FIG. 16). Based on these results and the positions of these probes, it can be deduced that the breakpoint interval spans positions 11004 bp through 65951 bp of FIG. 14. It will be evident to one skilled in the art that the region of breakage can be more precisely refined by hybridizing probes from the single copy intervals between Seq. ID Nos. 519 and 520. The exact location at the breakpoint can be then determined from the genomic sequence of the refined breakage region.

Recent studies (Herens et al, *Br. J Haem.*, 110:214–216 (2000)) utilizing the commercially available ES probe have demonstrated that ~10% of CML patients do not have an extra hybridization signal on the derivative chromosome 9 because sequences are deleted upstream of the ABL1 gene. In some instances, the deletions extend as far as the ASS gene and such a deletion is associated with poor prognosis (e.g., blast crisis). These large FISH probes are not useful for detecting interstitial deletions in the region between ASS and ABL1, as evidenced by an increased deletion detection rate of up to ⅓ of CML patients when shorter probes of 100–200 kb are hybridized (Sinclair et al., *Blood*, 95(3):738–744(2000)). Since some patients harbor deletions of sequences proximal to the ABL1 breakpoint on the derivative or translocated chromosome 9, single copy probes are being used to delineate the extent of hemizygosity in this chromosomal region. Correlation of deletion breakpoints with clinical outcomes will determine if the loss of specific genes in this chromosonal interval is prognostic for clinical findings such as early blast crisis.

EXAMPLE 5

This example demonstrates that increased hybridization signals can be generated using probe sequences from duplicated genomic domains. Several single copy probe sequences were designed, which were a part of highly similar duplicon or triplicon domains as previously described.

Several probes from chromosome 16p13.1 (SEQ ID Nos. 536–543), close to the inversion breakpoint in Acute Myelogenous Leukemia—Type M4, contain sequences that are a near perfect triplication of sequences in this region. In the genome draft sequence, two of these domains are tandemly arranged, separating the probe sequences by 40 kb, and a third telomeric interval is separated by 1.2 mb. The sequences of the three intervals differ by only ~1.5%. Hybridization with this probe demonstrated two clustered, but clearly separable signals. One hybridization corresponds to the combined first and second paralogs and the other to the third copy of this sequence.

A probe from the chromosome 17p11.2 interval that is commonly deleted in Smith-Magenis Sydrome (SEQ ID Nos. 586–587) contained a near-perfect triplication. The probe was intended to detect a deletion within a near single-copy sequence in IVS4 of the SHMT1 gene. However, two paralogous subsequences separated by ~15 kb, exhibiting 99.8% identity with the SMHT1 sequence, were also detected in the genome draft between the ZNF127 and PAIP1 genes ~2.7 mb centromeric but also within the genetic interval commonly deleted in patients with this disorder. Due to the proximity of these sequences to the chromosome 17 centromere (which is a highly condensed region), a single hybridization locus was observed.

Two probes from the Down syndrome critical region (SEQ ID Nos. 504/505–508/509) were each embedded in the same large duplicon, which was ≧80 kb in length. These duplicated sequences are separated by 1.1 mb, and reside, respectively at the centromeric and telomeric ends of chromosome band 21q22.2. Despite the fact that the duplicated sequences were separated by 1.1 mb, a single hybridization signal was detected in this region of chromosome 21 using each probe. Therefore, this region of chromosome 21, like chromosome 17p11.2, seems more condensed in metaphase chromosomes than sequences in 16p13.1, in which duplicated regions separated by similar distances were distinguishable.

Single copy probes developed from such regions, of course, lack known repetitive sequence elements. However the probes generally hybridize to all of the paralogous copies, since each of the copies remain hybridized even under the most stringent hybridization wash conditions. Because multiple, tightly clustered sites on the chromosome are hybridized in a specific interval, the hybridization signal produced from these hybridizations is brighter than that expected from a comparable probe sequence which was represented once per haploid genome. Thus, these genomic duplicons or triplicons increase the effective target size of the probe. This implies that shorter probes from such regions can produce hybridization signals comparable in intensity to those generated by longer probes. Selection of shorter probes from duplicated genomic domains will be particularly useful for development of probes for genomic regions where long single copy intervals are underrepresented.

EXAMPLE 6

The increasing availability of accurate draft human genome sequences has facilitated development of single copy probes in accordance with the invention for many previously inaccessible chromosomal regions. Although the most current comprehensive up-to-date sequence databases have been used to detect repetitive elements (girinst.org/repbase) present in these draft sequences, hybridization of single copy probes to metaphase chromosomes has revealed that several probes contain previously unrecognized repetitive sequences. This was determined by documenting hybridization of a probe to the homologous chromosomal band where it is known to be mapped as well as other locations not found in the draft genome sequence.

The draft genome sequence is incomplete, with ~90% of the euchromatic genome having been sequenced (International Human Genome Sequencing Consortium, Initial Sequencing and Analysis of the Human Genome, Nature, 409:860–922, (2001). It was anticipated that some repetitive sequence families, especially those present among the missing sequences, would have not been detected. Despite screening for known repetitive sequences, several euchromatic single copy probes appear to contain homologs of repetitive sequence families that are predominantly found in multiple copies on the short arms of acrocentric chromosomes (chromosomes 13, 14, 15, 21, and 22). These probes included three sequences derived from the Down Syndrome critical region on chromosome 21 (amplified with SEQ ID Nos. 504/505, 506/507 and 508/509), two sequences from chromosome 16p13.1 that straddle the site of chromosomal inversion in Acute Myelogenous Leukemia, Type M4 (amplified with SEQ ID Nos. 536/537 and 538/539).

Such chromosomal domains, termed nucleolar organizer regions, are known to contain thousands of copies of the ribosomal RNA cistrons arranged in long tandem arrays (Sylvester et al., Hum. Genet.; 73:193–8 (1986)). The human genome draft genome sequence is devoid of contiguous sequences from these chromosomal regions. The International Sequencing Consortium eliminated clones containing these and other tandemly repeated sequences (e.g., heterochromatin) from consideration early in the sequencing effort, since it was recognized that any assembly of sequences from such clones would be ambiguous, and thus unreliable. Other sequences distinct from, but co-localizing with, ribosomal RNA genes would most likely also be tandemly arranged in chromosomal nucleolar organizer regions. Because of the lack of sequence information from these intervals, the distribution of sequences within them that are related to sequences elsewhere in the genome has not been previously appreciated. While single copy FISH with these probes demonstrated localization to the expected euchromatic intervals, additional significant hybridization to the short arms of several acrocentric chromosomes was seen. Addition of $C_0t$ 1 DNA prior to hybridization removed cross-hybridization to these repetitive sequences. These additional signals are consistent with tandemly organized multiple copies of sequences related to the probe on short arms of acrocentric chromosomes.

In addition, hybridization of presumed single copy probes to interspersed repetitive sequence families was detected, despite the fact that these probes were filtered for repetitive sequences using RepeatMasker software. One probe, mapping to chromosome 17p11.2, within the interval commonly deleted in Smith-Magenis syndrome (amplified with SEQ ID No. 586/587), was found to cross-hybridize with interspersed repeats. Sequences close to the translocation breakpoint at chromosome 9q34 (amplified with SEQ ID Nos. 518/519 and 526/527) also potentially contain interspersed repetitive sequences, based on hybridization of combinations of these probes with another probe from this region. The hybridization signals at the mapped locations for these probes were not stronger than those observed for the cross-hybridizing sequences, nor were the cross-hybridizing sequences removed by increasing the stringency during the washing procedures. This suggests that the probes contain previously unrecognized repetitive sequence families, rather than highly divergent copies of known interspersed repeats (whose failure to be recognized by RepeatMasker software would have led to their inadvertent inclusion in the designed probe).

Although all of these probes appear to contain members of previously unrecognized repetitive sequences families, the probes themselves are likely to be composed of both single copy and repetitive sequences. It is feasible to separate these sequence components by iterative hybridization of different PCR-generated subsets of each probe sequence to chromosomal DNA. However, since each entire probe sequence is known, the sequence can be added to the repeat sequence database used to develop new, additional single copy probes. The probe sequences are not lengthy (some interspersed repeat families are, in fact, longer, e.g., L1, than the longest single copy probe); therefore, minimal additional computational overhead is incurred by addition of these sequences to the database of human repetitive sequence families. The addition of these previously unknown repetitive sequence family members results in a more comprehensive repetitive sequence database, that in turn improves the design of single copy probes. Single copy probes subsequently designed using the larger repeat sequence database, will not contain these novel repetitive sequences. This heuristic algorithm improves the purity of single copy sequences in single copy probes.

Generally speaking, the invention thus provides a method of determining the existence of previously unknown repeat sequence families in a genome. This method involves reacting a labeled, putative single copy nucleic acid probe with the genome, and causing the probe to hybridize. If the probe hybridizes at more than three different locations (and preferably at more than ten different locations), then it is likely that a new, previously unknown repeat sequence has been found.

All references cited above are expressly incorporated by reference herein. In addition, the subject matter of Disclosure Document #471449 filed Mar. 27, 2000, is also incorporated by reference herein.

SEQUENCE LISTING (613 sequences)

SEQ ID NO: 1 - DNA, 171 bp, Homo sapiens
  repeat_region (1)..(171): ALR
aattctcagtaacttccttgtgttgtgtgtattcaactcacagagttgaacgatcctttacacagagcagacttgaaacactctttttgtggaatttgcaagtggagatttcagccgctttgaggtcaatggtagaataggaaatatcttcctatagaaactagacagaat

SEQ ID NO: 2 - DNA, 290 bp, Homo sapiens
  repeat_region (1)..(290): Alu
ggccgggcgcggtggctcacgcctgtaatcccagcactttgggaggccgaggcgggaggatcacttgagcccaggagttcgagaccagcctgggcaacatagtgaaaccccgtctctacaaaaaatacaaaaattagccgggcgtggtggcgcgcgcctgtagtcccagctactcgggaggctgaggcaggaggatcgcttgagcccgggaggtcgaggctgcagtgagccgtgatcgcgccactgcactccagcctgggcgacagagcgagaccctgtctcaaaaaaaa

SEQ ID NO: 3 - DNA, 68 bp, Homo sapiens
  repeat_region (1)..(68): bsr
gatcagtgcagagatatgtcacaatgcccctgtaggcagagcctagacaagagttacatcacctgggt

SEQ ID NO: 4 - DNA, 382 bp, Homo sapiens
  repeat_region (1)..(382): cer
ctgcagaacactacttccagggtctaaatgtctgtccttcacataggattccagaacactgctacgagagtgtgaatgtttgtccttcacatagcatttcacaactgccatggtctgaatggttgtccctcacatagtattccagaacactgctatgagggtctgaatgtttgtacctcacataggattccagaacactgctatgagggtctgaatgtttgtacctcacataggattccagaacactgctatgagtgtttgaaagtttgtccctcacataggattccagaagactgctgctggggtctgaatgtctgtccctcacatcggattccagaaccctgctgctggggtttgaatgtctgtccctcacatagaattc

SEQ ID NO: 5 - DNA, 2739 bp, Homo sapiens
  misc_feature (1195)..(1195): n is a, c, g or t
  repeat_region (1)..(2739): charlie1
cagcggttctcaaagtgtggtccgcggacccctgagggtccccgagaccctttcagggggtccgcgaggtcaaaactattttcataataatactaagacgttatttgcctttttcactctcattctctcacgagtgtacagtggagttttccagaggctacatgacgtgtgatgacatcatcgctctgatggctaatggaatgtgtgcttgtgtattcttgtgttttctaaaatttttaaggtagtaggtttagggtataaatatgtaggttttcagagattaactcagtttsttcttagcacttctaccgtgctcttactagctatcttcagttatacctgctataatctttgtaacctcattatcgtccaataaatcattattttraaatcctaaagttttcctcgwgcctatgtgaaaacacaagaagcaagtactacttgtaaaacttgcttgcaataacattttgaaaatttcccaaatgtttaaattttatcgacaacatatagaatttaatattttattctaaaataaaaatttatttataawgtttttcctatatttaagggtggattgttggcttaaaaaagggagattagaagactcgctttctcaacccacagctgcamcatctatgtctaaagatgctgaaatggacataccagcaagttctctgattcctcatggaarggaggaatctactccaaagaaactgggcgaaactgtaaataaaaaacaaaaatatgataaaagctatcttctcagctttatagatgttaataatttaccttattgtgtcttatgcaacagaacattttcgaatagtattatggtgccagttaagttgcggcatcattttgagaccaatcattcagagtttaaagaaaaaggaattaaatattttaaacgtagatgtgatgagctctttaaaagccaaaaattgtttgttgcagcttttcaaactagaaatgaaaaagccactgaagcatcttacaggataagttgccayattgcattggctggagaagcmcacacaataactgagagactaataaagcctcgaacagttgacattgctgaatgcctgctggatgaaaagtcagtaaaagaaatcatagcactgccactttccaatgatacgataactcgtcaaattaaagatttagctgcaaacatgaagaccgagttaatatntcatctgcagaattgtacttttgccttacaaatggacgaatctacagatgtkgctagacttgctgtgttgcttgcgttcgtctggtatcagcaccaactgatcatcgaagaacttcttttatgtgaattcttggcaacaaacacaagtggtgatgaaatattcaaagtgttgaatgacttttttgaatctcatgatttatcctggaacaactgtgttgacatttgcactgatggtgcaaaagcaatggtgggtaaaactgctggcgccttagcacgaatcaaggcagtggcaccaaactgtactagtagtcattgtattcttcaccgccacgcactcgcagtwaaaaaaatgccagtttcacttaagaatgtccttgatgaagcagtaaaaattattaattttattaaatctcaacccttgagtacacgtctttttaatattctgtgtgacaaaatgggaagtacgcataaagcacttctgctgcataccgaagtacgatggttgtctcgaggaaaagcacttgtgcgattgtttgagttgcgagctgaactagctgcttttttcatggaacaccatttttacttgaaagaacgactgacagacaaactatggttattcagacttgggtatttggcagacattttctcgaaaatgaacgaagtgagcctgtcacttcaaggaaaacaactgacagtatttgttgccaatgataaaattcgagctttcaagcgaaaattagaattttggaaaacttgtatccgccaccgtgagcttgacagcttcccaatacttaaagacttttctgatgagatcggtggtgatattaacgaatgtgattttttgatattgtataatgaaatgtgtcaacatttggaagatctgcataactcagtgaaccaatattttccaaatgaccaatgcatgatgttacaaaatcatgcatgggtaaaagatccattcaaagtgcaagatagaccaatggattttaatgtaacagagtatgaaaagttcattgatatggtttcagattccacattgcaactaacctttaagaaactaccacttgtcgagttttggtgtagtatcaaagaagaatatccacaattatctgaaaaggctattaaaatactcctcccttttccaactacatatctgtgtgaggccagattttcttcatatacttcaaccaaaacaacatatcgcaacagattgaatgcagaagcagatatgagaatccagctgtcttctattaagccagacattaaagagatttgcaaaaatgtaaaacaatgccactcttctcactaaatttttttgttttggaaaatatagttatttttcataaaaatgttatttatgttaacatgtaatgggtttattattttwaaatgaatwaataaatattttaaaaatttctcagttttaatttctaatacggtaaatatcgatagatataacccacataaacaaaagctctttggggtcctcaataatttttaagagtataaaggggtcctgagaccaaaaagtttgagaaccgctg

SEQ ID NO: 6 - DNA, 2760 bp, Homo sapiens
  misc_feature (173)..(173): n is a, c, g or t
  repeat_region (1)..(2760): charlie2
  misc_feature (363)..(364): n is a, c, g or t
  misc_feature (476)..(476): n is a, c, g or t
  misc_feature (510)..(510): n is a, c, g or t
  misc_feature (535)..(535): n is a, c, g or t
  misc_feature (541)..(541): n is a, c, g or t
  misc_feature (599)..(599): n is a, c, g or t
  misc_feature (625)..(625): n is a, c, g or t
  misc_feature (721)..(721): n is a, c, g or t
  misc_feature (764)..(764): n is a, c, g or t
  misc_feature (1088)..(1088): n is a, c, g or t
  misc_feature (1122)..(1122): n is a, c, g or t
  misc_feature (1155)..(1155): n is a, c, g or t
  misc_feature (1202)..(1202): n is a, c, g or t
  misc_feature (1220)..(1220): n is a, c, g or t
  misc_feature (1231)..(1231): n is a, c, g or t
  misc_feature (1399)..(1399): n is a, c, g or t
  misc_feature (1417)..(1417): n is a, c, g or t
  misc_feature (1430)..(1430): n is a, c, g or t
  misc_feature (1433)..(1433): n is a, c, g or t
  misc_feature (1453)..(1453): n is a, c, g or t
  misc_feature (1469)..(1469): n is a, c, g or t
  misc_feature (1472)..(1472): n is a, c, g or t
  misc_feature (1487)..(1487): n is a, c, g or t
  misc_feature (1488)..(1488): n is a, c, g or t
  misc_feature (1530)..(1530): n is a, c, g or t
  misc_feature (1564)..(1564): n is a, c, g or t
  misc_feature (1606)..(1606): n is a, c, g or t
  misc_feature (1695)..(1695): n is a, c, g or t
  misc_feature (2300)..(2300): n is a, c, g or t
cagtggtcttcaaactggggtatacatacccctgggggtacatgaagactttccaaggggtatgcgggcacggatagttttaagggaatcaatttccagatcctcarcttccatatgtactctttcctaaaactgatctgcctgagaacgcgcctgtggcgagggcctgccgnctttcccacttcccctttcacgatcgcccttctcccactttacaaaagaaaggcatacctctcacccatcccgaatcttactatggtgcattgccctggggtgtaaaaacctccggggcaccaaacaaagggacaattcgaaatactggtgttggtgaagcctcctttaatcaaggcaccataarcccgnngtacagttttatgtcttccctggctttayaaatatttctgttaagggtaaagcatgatgttggaacaaggtactttggcycatgttggggtgttctgaattcagatatatcntagagtggggtggtgggagtgatgacgatttttncttgacgatgttgcttcttccatcnctattnacaaagaatacattgctcctgaggaagagtcctgagagcaaagcaaagagaacattgntaagaaatggcgaagatggcagtgcnttatttcatccaggtgacaaactcatggcgaggtctatctatctgakagttggaatattcaagatwtgkaaaaggcattctgggaaataccaatcngctacgaagcatgcctcctctgcactttcaccattctcagtantgagaaagagcttggtgagtactctcattcacctgcgtcttagtctgkgtctcagttgcatattttgcatgatttcaaggmggtggaggcgaaaagctctgcaattacttctaacagatcaacattacattttcaagtaaaaggaacatatattggaggtaagttmrtgtatkctattttcttgaacatttattcagattmataggagaaacattttcattaacttttgccaaagatttctagatagtgtaaatatatttttctatttaggcamaagtctcctgctcactgtcactcatgaacmacttctctgttcatttattnattcctaccatatacttactagagttagattaanttaacaggaatatgttgcagattctactgtaantaatgcacwtaatagcagtcagtaatataacttttgtaaacccatanttattaatgatccaatancttctctctcnttttgctgwcgatttccacaaagtagattaaactgtactcttaaaagcagaacattcacttatgtacgagtgcaggacagaatgttccaaaatgcaatstagaatgcgatgcccwgaacttcagaaaaccagcttcacttaattaggattaatttctcccgctcggangctaatatactgttttanttctgtcaaatgnatnattataagtaataatttttnacaataacgaaattantantatatacatgaatannctcaagtgtccgtccctctgtcatatttttaaaatgcatttngagacgttcttaaaaaatgaaatwtggtattgtntataggtctctgttcgtagtcgakgagamaagtccccaaatncacaatttacaatttttcgwtttttccaactccttccatgtatattgaggtccataagcaaggtgcctctaagtgaaagagtagcaggnataattaatagtcatttgataagtcttggtgaagccttttgggtatacttcctagaaactgagaaagtgaatgactctaatgactgggtaacaaatccttttgcaagtcaggtggtttccaattctttgctttcaacaaaattgaaggaggacctaatcgagttgtcagctgacagatcattaaaaataatttttgatgatagatcaytatgtgatttttggcatataactcggaaggagttcaaagaattgagtgacattgctataacaaaactccttccattcccatctacttatttatgtgaacaagrtttctcagcgcttacatctataaaaatgaaaaataggaatagaattgatgctgaactctgtctcattctagcaataagtaatattcatccacggatacatgaactaattggggaaacaaggccccatccatctcattaagagatgcatttccaataaaattttactttttatgtttawtatttatcaaaatttgtaatatgtttatgttgttttgatcaattgtatattaataataattgtaatgataactcaatccagaagaaaawttttaacacttagagccttatggtcanarkaaatataaaaaattaaatttcaatttatatacatatttttgttgcagagaagtatgatagggtgatcaataaaagactttcaagcataaaaatatattacattaggataaaattctgtgggggaagtggaatggaaatacgagttcaaggagaaaaagagaacaatgtaaaatttccgactgttaaagaagagcttgctcatgtattttttaaatggatgatggtgggtatcaaatcgctatggtatttagattccattggatacatttaaaagagtgatgtaacagttttattttaaaatgtcaatatttacaatatgccagaaattacatcctttgcaactatttaaacttatgatgaaaaattttagatgtcaacttaaaaatgtgcgagggrgtacatagtttttcaaaattcttttaggggatacgcaagcaaaaawgtttgaagaccactg

SEQ ID NO: 7 - DNA, 2710 bp, Homo sapiens
  repeat_region (1)..(2710): charlie3
  misc_feature (744)..(744): n is a, c, g or t
  misc_feature (747)..(747): n is a, c, g or t
  misc_feature (954)..(954): n is a, c, g or t
  misc_feature (1703)..(1703): n is a, c, g or t
caggggtccccaacccccgggccacggaccggtaccggtccgtggcctgttaggaaccgggctgcacagcaggaggtgagcggcgggcgagtgagcgaagcttcatctgtakttacagccgctccccatcactcgcattaccgcctgagctccacctcctgtcagatcagcggtggcactagattctcataggagcgcgaaccctattgtgaactgcgcatgcgagggatctaggttgcgcgctccttatgagaatctaatgcctgatgatctgaggtggagctgaggcggtgatgctagcgctggggagcggctgcaaatacagattaacattagcagagaggtttgactgcacagagaccataataaatcaattgcttgcagactcatatcaaaaccctatcagtgagtggcaagtgacaattaagctgcatctggtggcaggctttatagtggcaagtgagttgatgtacttcaattgtacagctgcatctggtggcaggctttaagtcagaatccgacacttattttagtccgcgcgtggcctgctcattattttatttaccacttccatccgcgcctctttcccgcactgcgcacttgtctcagtcacagttttggtaagcccacaagctaaccctagccaaaatgagtaaaaaacaaacgtcactggagagcttctttgaaaagggggaaagacccaatgatgagacagcagaagactctaagactgccaamaaaaanaangctgcatttaaaagaaaataccaagagtcctacttaaattacgggttcattgcaacaggtgattcacattctccaagcccgctttgtataatatgtggtgaccagctatccaacgaagccatgaaaccttcaaaactgcttcgccacatggagaccaagcaccctgcattagaagacaagcctttggagtttttcaaaagaaaaaantgtgaacacgaagaacagaagcaattattgaaggccaccacttcatcaaatgtgtctgcactgagagcatcattcttagtggctaaccacattgctaaagctaagaagccctttactgttggtgaagagkktgatcctgcctgctgccaagssacatttgtcatgaactctwaggagasgmtgcmsttcaaawggtggcatgtgttcmtctttcakctttcagccaccacaacmagacgaactggtgaaacagcagaggatattgaggcacagttgttagagaggatkaatgagtcaccgtggtatgcaatccaggttgamaagtctaccagtgttaacaacaakgmaacaakgcttgcttttgtgkgatatatttttcaggaggatgcgcawgaggatatgttatgtgcacttttgttgccaaccaacaccacagctgcagaattattcaagtctttgaatgattacatatcaggaaaactgaattggtcattttgtgtcggtatatgcacagacagagtggctgccatgactggatggctttctggtttcactactcgggtcaaagaggtcgcttctaaatgtgagtctacacactgcgtcatccatagagaaatgctggctagctggaaaatgtcacctgaacttagcmacgttttgcaggatgtsmttaaaattatcaaccacattwaagtacatgcccttaactcacatctgttcgcgcagctctgtgaggagatggacgcagngcacacacgtcttctcttatacacagaagtgagatggctttctaaaggtagatcactggccagagtttttgagttacgagagccgctccagagatttcttttagaaaaacagtcaccactggcagcacatttcagtgacatagaatgggtcgcaaaacttgcttacttgtgtgacatattcaacctgctcaacgaactcaatctgtcacttcaggggagaatgacaactgtgttcaagtcggcagataaagtggctgcattcaaagccaaactggaattatgggggcgacgagtgaacattgggatttctgacatgtttcaaacattagcagagattttgaaagagactgagccagggccttctttctcccagctggtgcatgatcacctatctcagctttcaaaagagtttgagcattacttcccaaccacaaaggaccccagaactgggaaggaatggatccgcgacccatttgtgaataagccagstgaatcgactttgtccgtgctagaagaggatcaactgcttgagactgcaaatgacggtggccttaaaagtatgtttgagacaacttcaaatctccatacattctggattaaagtcaaagcggaatatcctgagattgccacgaaagcactgaaaagcctgcttccatttccagcatcctatctttgtgaagcagggttttctgcagtgacagcaaccaaaacgagattacggagtagactggacataagcaacacacttcgggtgtcgctgtctcccatcacccccagatgggaccgtctagttgcaggaaaacaagctcagggctcccactgattctacattatggtgagttgtrtaattatttcattatatattacaatgtaataataatagaaataaagtgcacaataaatgtaatgcacttgaatcatcccgaaaccatcccccccccctggtccgtggaaaaattgtcttccacgaaaccggtccctggtgccaaaaaggttggggaccactg

SEQ ID NO: 8 - DNA, 2585 bp, Homo sapiens
  repeat_region (1)..(2585): charlie5
  misc_feature (91)..(91): n is a, c, g or t
  misc_feature (143)..(143): n is a, c, g or t
  misc_feature (413)..(413): n is a, c, g or t
  misc_feature (786)..(786): n is a, c, g or t
  misc_feature (838)..(838): n is a, c, g or t
  misc_feature (918)..(918): n is a, c, g or t
  misc_feature (1043)..(1043): n is a, c, g or t
  misc_feature (1212)..(1212): n is a, c, g or t
  misc_feature (1257)..(1258): n is a, c, g or t
  misc_feature (1305)..(1305): n is a, c, g or t
  misc_feature (1709)..(1709): n is a, c, g or t
ctgcgctgtccaatacggtagccactagccacatgtggctaytgagcacttgaaatgtggctagtgcgactgaggaactgaatttaatttntattattaatttaaatttaaatttaaaaactgaaacagtataaaatattttnccattaaacayaactttattgttttggtaggactatayttcactttaaccattgcatcgcgkcatatagatattgttgtattgtagtgcgcgtgtcgggtacgtgcgtcatttctagtattacacgtaaacacatcactaatctagtcggtgtcaayagattgattcagttcaaatgatttttttctrtgcactgatgtaacattgtaatgtgtttatttgaatattttatgcagacagcacgarttacagtgatacctatgtaaatcanaattggtaactaaattgaaatacttattattttmattattataaattattttcttagttaaaaataaatgtggamaaatttaaatttaaaacgaaggcatactactgatgtagaattgagtggagatgcagaagttagtactatgactagaatagtaaagaaacaagagactggaagaaggtatgtcgcaaatttcatgatgaatggcaattgcaatttgctgcggcagagcaaaacaaaaaagctgtttgttgtgwaaaaaatgttaaagataacaaagtagacaatattgagagacattttcagcaaatacatagtgaatttgataagtttctcctccaamagtcaaaaaagaattaacaaaattagtcgnctgaaatcagaattaaatgtccaacaaaaaatatttaataagttttaacagnatctaagcttgtaactttggccagctataaaatgtcttggattcttatwcaaaaaaagaaaacaattttagatggagagntggtaaaagaaattatttcagttatggaaattttgttagaaagttatgaggaaaagactaaaaagatattttacaaaaagtgaaagatcttcaattaagccaccaaacaattgcccgtagaatgnaagaccttkctaacaatatcaaagataaattgattcaaaatttgaaaaattgcaagkactttagctttagatgagtcgtgtgatatgagacactgcccaattaatactttgggtatgttttactcaaaggacttscaaatttacaaagaaatctgttgtcaattcatgncttaaaaaactcgtagcaaagattttttaaactcttttacatctnncaaagaakaatttcacttagatatgaaaaaaaatktttctatcacgncggatggtgctccagctatgttaggtcaaaaatccagatttattggaattttaaaacaagagactgatgttttccttattgcttcattccactgwatgatacatactgaaaatatttgtgctcagttttctgaagcagactccgtgaaaggwgtcatgggtacagttgttaaaattsttcagtatatacgtgcaaatgctgtgaatcaccgccagtttatggaactgttgaaagaaatagaagacaatgaatttaatgatcttgtgttctttgccaatgttcattggttgagtcatagaagagttttacaaagatttactgtactgttaactccaattcaagattttcttgaaacaaaaggaatgcttgccaaatattcaataatcaaagacaaaaaatggcantgtgatttacgttttctcaccaatatcacactgcatatgaacaagctaaatttgaagctccaaggaaaggaaaagcttatttgtgacctagctagacaggtataagaatttatgttgaaattgaaacttttcataatacaaatcaataataatgattttacacatttttctaacgtgaatcaatatgcagaagattttaattgtaattgacagtattatgtaaattggctgcaaaaactacaagaaaaatttgaagaatattttgttgatattgataaatttagaattgcttttcaatttatgcaatacccctttgaattcaatgttaataatactgagttgacacaagaattagtgaatttacttaacttggacagacatagttttgaaactgatatscttttgcttcaaagtaaaatcaattcttctaaaaaaatgaaccagttttgtcaatgtggatttaaatattaaaagaaaatgatttttgatactcgattcagttattggaaaacttttaagtatgtttggaacaacttgggtatgtgaatctactttttcaactgtaaattttatgaaatctaaatacagatcaagtatttccgatgaaaatttagcgtccgaattgagatgtgctgtaagtgtaaaatacacaccggatttcgaagacttagtatgaaaaaaagaatgtaaaatatctcattaataatttttatattgattacatgttgaaatgataatattttggatatattgggttaaataaaatatattattaaaattaatttcacctgtttctttttactttttttaatgtggctactagaaaatttaaaattacatatgtggctcgcattatatttctattggacagcgctg

SEQ ID NO: 9 - DNA, 2869 bp, Homo sapiens
  repeat_region (1)..(2869): charlie6
  misc_feature (37)..(37): n is a, c, g or t
  misc_feature (47)..(47): n is a, c, g or t
  misc_feature (50)..(50): n is a, c, g or t
  misc_feature (54)..(54): n is a, c, g or t
  misc_feature (104)..(104): n is a, c, g or t
  misc_feature (115)..(115): n is a, c, g or t
  misc_feature (135)..(135): n is a, c, g or t
  misc_feature (149)..(149): n is a, c, g or t
  misc_feature (156)..(156): n is a, c, g or t
  misc_feature (179)..(179): n is a, c, g or t
  misc_feature (246)..(246): n is a, c, g or t
  misc_feature (258)..(258): n is a, c, g or t
  misc_feature (293)..(293): n is a, c, g or t
  misc_feature (321)..(321): n is a, c, g or t
  misc_feature (338)..(338): n is a, c, g or t
  misc_feature (359)..(359): n is a, c, g or t
  misc_feature (415)..(415): n is a, c, g or t
  misc_feature (501)..(501): n is a, c, g or t
  misc_feature (533)..(533): n is a, c, g or t
  misc_feature (566)..(566): n is a, c, g or t
  misc_feature (630)..(630): n is a, c, g or t
  misc_feature (646)..(646): n is a, c, g or t
  misc_feature (669)..(669): n is a, c, g or t
  misc_feature (673)..(673): n is a, c, g or t
  misc_feature (713)..(713): n is a, c, g or t
  misc_feature (745)..(745): n is a, c, g or t
  misc_feature (764)..(764): n is a, c, g or t
  misc_feature (808)..(808): n is a, c, g or t
  misc_feature (811)..(811): n is a, c, g or t
  misc_feature (877)..(877): n is a, c, g or t
  misc_feature (882)..(882): n is a, c, g or t
  misc_feature (908)..(908): n is a, c, g or t
  misc_feature (993)..(993): n is a, c, g or t
  misc_feature (1023)..(1023): n is a, c, g or t
  misc_feature (1049)..(1049): n is a, c, g or t
  misc_feature (1100)..(1100): n is a, c, g or t
  misc_feature (1204)..(1204): n is a, c, g or t
  misc_feature (1228)..(1228): n is a, c, g or t
  misc_feature (1255)..(1255): n is a, c, g or t
  misc_feature (1266)..(1266): n is a, c, g or t
  misc_feature (1269)..(1269): n is a, c, g or t
  misc_feature (1284)..(1284): n is a, c, g or t
  misc_feature (1292)..(1292): n is a, c, g or t
  misc_feature (1298)..(1299): n is a, c, g or t
  misc_feature (1335)..(1335): n is a, c, g or t
  misc_feature (1483)..(1483): n is a, c, g or t
  misc_feature (1494)..(1494): n is a, c, g or t
  misc_feature (1590)..(1590): n is a, c, g or t
  misc_feature (1608)..(1608): n is a, c, g or t
  misc_feature (1610)..(1610): n is a, c, g or t
  misc_feature (1621)..(1621): n is a, c, g or t
  misc_feature (1665)..(1665): n is a, c, g or t
  misc_feature (1672)..(1672): n is a, c, g or t
  misc_feature (1733)..(1733): n is a, c, g or t
  misc_feature (1824)..(1824): n is a, c, g or t
  misc_feature (1930)..(1930): n is a, c, g or t
  misc_feature (2014)..(2014): n is a, c, g or t
  misc_feature (2047)..(2047): n is a, c, g or t
  misc_feature (2198)..(2198): n is a, c, g or t
  misc_feature (2211)..(2211): n is a, c, g or t
  misc_feature (2220)..(2222): n is a, c, g or t
  misc_feature (2452)..(2453): n is a, c, g or t
  misc_feature (2466)..(2466): n is a, c, g or t
  misc_feature (2486)..(2486): n is a, c, g or t
  misc_feature (2555)..(2555): n is a, c, g or t
  misc_feature (2623)..(2623): n is a, c, g or t
  misc_feature (2683)..(2683): n is a, c, g or t
  misc_feature (2742)..(2742): n is a, c, g or t
ttgcttgkgcccaktttcggkcwgtgatgcaagatangggaagctantgntaantggtgagtgctgcattacacagamgagaggggcggtaaaccgatgacatnagtttcccctnctccaattatttcccccagnctccccttatgcgntgccggntgacttaaggaacgaacaacctncgctagtataacgaaaatcagagggaatttgttttcattctaaggaaggagtttttacgtgccgcanctcagctctctncctgmcactttgttgttaaaacattgcaaaacgtnggttcaagtaggctagaagtgaattgtncagtgaagttttwttanttttgagattttcttgtttangtatgcttttwtgtttttcttttaactaatgtttgtgttttataaacatgtctganagcccaatgtggcaatttttgaaggcgagatgtgagatggaagaggaagwttctaggcctgggtctacggacaattctgataaggntagtgatgaaggattatagccttctgagtatncttcagtgtactagtgcaacaagggacacaganaaagtctatctttacgacgaaagccacttatcaakggttttatatgggctggtagtccaagctntcttattccattgtgnatcgtctgtggcaaacaacttanaaangcagcaatggctccagcaaaattgaaaaaacaccgtaacnataagtcacagctatttgacaagtaaagatgntgattatttttaaacggcnattggactctcaaaacaaacgagtaaagctttcgttcaaaaawnacntttagtgaaaaggctcaggaagcaagttatttagtagcagaacttattgcccagaaaaggaaaagncacanggttggtgagaacctaataatgccancatgtaaaattacagtgaatcaaagcctgggcaagatgcagtacgagaaattgaaaaggctccactctcaaacagtgcgataagntgacgtattgatgacatgtcacatgatgcnaaagaggttttgtgtaataaactganaaatagcagcttctctatccaggttgatgagtcaacagatttcactaatanatgtcatgctgtagcatttgtaagatttgtaaaggatggtgaaattcaagaaaacattttctgctgcaaagagctgcccaaaacaaggaaaggccaagatatanttaatgttttgacttcatatctgnaaaccagaggtctmagaaccgcgctgncatctacactnatngtgctccgtcagtanttggttcnatgagnnattttgcgttattaaataaaaaaagagaagkcctknttttcacattacagcacactgctttctccacagagatgctgatgtcaaaaactcttggagatacagtgaaagttctggataatgttacaaaactggttacctktattaacaaaggccaatttatgcgaaaatkttaaaaaaaaaaaangagacaacctnggcagasagcacataaacctcctgcaccatacagamatccggtggcttmkcagaggaagcgttctcwacagggtgtttgagttgaagggtgaattnccagagtactttcaawananggccggccagnttttgctgagtgctttggaatgaaaaatggctgcagaaagtcgnctacttngcagacatttttcatcacatgaaccagtgaacaagtctctgcaaggccctggagaaaatgntttkacttcgagtgacaagatttttggatttaaaaggaaactgaatctttggaaaagtcatgttgcaaaaggaaatcttgaaatgtttccnctgctgcttgggcttgagagtgaggaaggatatcagcmagtctcaagtcttactgaaaaccgcctggaagaaccgcagaacaaaacaaatggcattttccctcccnttcaacacaagtgtgtggctaggtgagggaccctttctctgaatctgctcagcctgagaacctggctttgagagaagagaaagnactttgtgagttgcggtctgatcgcacattcangatgagatttcctkatttttaccctaggcgcgttctggatcccwgtgamagaagmmtctcctgccactcgcaggaaagcagtgggcatktktgccgwgsttctcmacctcctkcatgtkgswkkaacaggctcgctcacgttttactaagnatcaagagcaagngcagaaatnnnctcatttcagttgaaaatgaaatctttatgtagctgtstsawgctcgatcmataattgagtgaaataaactgatcattaactatgtacaggtttcatgtgagagagtaacatatttttagtttaagtttcaaaaacaktgttttagtctatgcatgtgtaagcctaaaacagagatcaagaaactaatgtacatatataaaaatattattaacttctaggcctgtatttnnacctgatcatgtnactcagtaagaaatgttatnttttcaaagtcttatataaaattgtgcttaggctatattttattcatatttctttgcttacagttttantagctttactattcaacattgccaataaattttcatgttgtaaataacattaattaaaatcaatttanaatatttatttaaattaaatctaccgagcctacttttagaaaaattaaattccattttgnctcaagccagttatttaacagaaatttgcttgtcttatgtttttttaatttatgaaaangaaagaaagatwatttcaagaamagtaagctawgtctaacawcttttttctaggtaaaakttggmtagawggtmactcttakcttcwaatawggaagaatgtamaactagtcttgtatgtwcmatgt

SEQ ID NO: 10 - DNA, 2285 bp, Homo sapiens
  repeat_region (1)..(2285): cheshire
  misc_feature (377)..(377): n is a, c, g or t
  misc_feature (580)..(580): n is a, c, g or t
  misc_feature (651)..(651): n is a, c, g or t
  misc_feature (664)..(664): n is a, c, g or t
  misc_feature (725)..(725): n is a, c, g or t
  misc_feature (728)..(728): n is a, c, g or t
  misc_feature (1095)..(1095): n is a, c, g or t
  misc_feature (1151)..(1151): n is a, c, g or t
  misc_feature (1281)..(1281): n is a, c, g or t
  misc_feature (1351)..(1351): n is a, c, g or t
  misc_feature (1370)..(1370): n is a, c, g or t
  misc_feature (1385)..(1385): n is a, c, g or t
  misc_feature (1885)..(1885): n is a, c, g or t
  misc_feature (1912)..(1912): n is a, c, g or t
  misc_feature (1990)..(1990): n is a, c, g or t
caggggtcggcaaactatggcccatgggccaaatctggcccaccgcctgtttttgtactgcccgtaaactaagaatggtttttacatttttaaatggttggaagaaaaatcaaaagaagartattttgtgacatgtgaaaattatatgaaattcaaatttcagtgtccataaataaagttttattggaacacagccacgcccattcgtttatatattgtctatggctgcttttgcgctacaacggcagagttgagtagttgcgacagagaccgtatggcaytctcattgcctttgcactsctgtttctraactataaccagtgttttgagtgccatgcatattactgtactgtaacattttwttytattattaatgnatacycatcatgtcaaaacaagaaaagaagagaaaagtrgactttgaatgttrcacttttaaggcacaatggagtatggattattttgttatggcaaagcattttattatgcaatgacactatagctgtgctaaatacaatatacattgacattaccagactaagcactcatcacartattcccaaatcacaggaaagcaatngtcagaaaaattagaaaatttaaaacagaatatctcatcacagcagaatttcttcacaaaawtaaaaaatnaaaatgaggctgnaaccaaagtaagtttctgagtggctcatttgttagccaaggaaggaagtcatttaccaatngtnaattaattaaatcatgttgattgcagcaggcatagaaatgtgtctagagaaaataaacttaaaactattagccttttgataagaagagttgcttaaagagttgaggacatcaataatcaattaaaaaggcaaatgrttttgagtggttttccttggctcttgatgagttgacaggtgttactgatactgctcagttgtttatttgaggagtcaatgctgagtttgaagtgctgaatagccttaatgaatagtctgtgtggaataattgcagacaagaatatttcaaaaagttgagaaaacactaattyagtacaacctgaaggaagtggaatctgctaagatgtgttaaaactgatggtggtaaaantatgtgtggagcagaaaaaagcttagttggacaaataaagctgtgaaaatgtaagntgtttaaagyctatggttatttattttattcatcagcaagtactttgtagaaaatatttgaatctatcatgtgatattgaaccagtagtgtcaacatttgctcttgtggacttaaccattgtcagttctntaaatttttgtcagaaatagaagctgaatatcctgacttgccctgctatacagyagtttgatggcttagnagtgctaaagctttattgntattttttgagctynggactgagattgaaatttttctgaatgagaagaactrctctcaaactrtttatcaaacactgagtggctttggaaattagcttttgctgcagatttgataatatttcttaataaattcaacctaaaattacaaggcaaaacagcacttatattgaaacttatactgttgtaaagtcatttcaatgrcaacaactattgtttgaatcacaagtaatgtcaagctgctttatatacttcccatgctatcaaaagttaaaacaaagaagtaagatctccattcccacacaatttgtagcagatatattttccaaactcaaactacagttccagcagcattttttggaccttgatgcaagtgcaaaggaaatwtccatttaactgtgcaattgagaagcttcctacctaaccttcaattggaatgattaatctgcaagtaatgacatgcaaatatcaagagaaaattctataaatgccttccaagcaatgaatatgctcaattnaaatcatatgctcgtgattgatatcantatttggcaatacctatcctgcgttgaaaataaaacattttcaaacatgaaatrtgttgcattacagattagcatttnaacagatgaacatttgcaatcrattttgatgatagggaacactaactttgaaccccaattaagcaaaatgttatcccwaaaaagaattccattcttctcattagtagacctgtattacaaaaaattgtactcaattattattwttattatattttgaatttcatcaataaaaattgtggaattttttctcttgttatataagtacctacataatatccttgattttgcctcttggcccgcaaagcctaaaatatttactatctggccctttacagaaaaagtttgccgacccctg

SEQ ID NO: 11 - DNA, 453 bp, Homo sapiens
  repeat_region (1)..(453): cr1_hs
  misc_feature (199)..(199): n is a, c, g or t
gaggttcaacaaggccaagtgcaaagtgytgcacttgggttggggcaatcccaggtatrtatacaaactggggaactatgagcttggcagcagccctgtggagaaggatctgggggttctagtggatgawaagtttaatatgagccagcagtgtgctgttgctgccaaaaaagccaacagtatcctgggctgcattaanaagaggattgacagcagatcamgggaagtgattatacccctttacaatgccttggtgaggccacatttggaatactgcatccagttttggtcaccccaatrcaaaaaggatgttgagactttagagagagtacagagaagagcaacaaagatgatcagagggctggaggacctaacctatraggaaaggytgatggaattgggcttgtttagtttgragaagagaaggatgaggggagacatgatagcagcctt

SEQ ID NO: 12 - DNA, 75 bp, Homo sapiens
  repeat_region (1)..(75): ggaat
ggaatggaatggaatggaatggaatggaatggaatggaatggaatggaatggaatggaatggaatggaatggaat

SEQ ID NO: 13 - DNA, 2986 bp, Homo sapiens
  repeat_region (1)..(2886): golem
  misc_feature (2326)..(2326): n is a, c, g or t
cagtcatgcgctgcataacgacgtttcggtcaacgatggaccacatatacgacggtggtcccataagattataatggagctgaaaaattcctatcgcctagtgacgttgtagtgcaacatatyactcaktactcacgcgtttgtggcgatgctggtgtaaacaaacctactgcgctgccagttgtataaaagtatagcacatacaattatgtacagtacataatacttgatagtgataataaatgactatgttactggtttatgtatttactatactatactttttattattattttagagtrtactccttctacttattaaaaaaaaaagttaactgtaaaacagtatgccgtgttagaccggcagcagccacatgcatctcgtgtttaccgcgtctcttgattgcatcattttctcttgtgcttgatttaatctcatgtgttttgttcatcacggctcctaagcgttcaaaatccacggctaatgttgccagtaagaggccacgtcgagtaattgagctggaaacaaaattaaaagtgattaaggaccgccgaaggtggaaaatcagtgatggttattgctcgccagacaggtatgtcccattcgaccatagctgccaccttgaagaacaagagcaaagtgacagaaactgttaaagggtctgcttcatcgaaggcgacgagaccaacaaatttgagaagtgccaacatcagatatggagaatatctgctaatgacctggattgaaaaccagacacagaaacatagctctctcagcaccacgacgaccacggccagagcaaaagggatatttttgatgttgaaagaaaaggctggacccgactgtgatatcgaatttactgctagttccgggtggtttaaatgattcgagaatcgttatccattacataatgttaacgtgactgctgagtctgtgagggctgacgtgaaggcagctgaagagtttttggaaactctagatgagtcgtggagaagaaatacttgccagagcaaatcttcaatatggaggaaacctccctattctggaaacagatgcctgaaaggactttctgtcataagggggccaagtcaatgccaggtttcaagggttttaaggacaggaaacggtcttgctttggggcaatgttgcaggctacaaattgaagccctttgtgatccgacacagtgaaaaccccagggccttcaagcatatcagtaagcacacgctgccagtgtactacaggagcaataaaaagtcatggatgatccatctcctcttccaagatgccctcctgaattgctatgccagagaaatggagaagtactgtttggggaataacatacctttcaagattttgcttattgttgataatgctcctgcacatcttccttttactggtgatcttcatcccaatttcaaagtggtgtttctctctccaaacaccacctctttgatccaatggatcaaggaattatagcagctttttaaaggcctactaccagagaagggccttcgcccaggttatcactgtaactgaggaagacactgatgcaattctggaaggattacaacagccaagactgcatcaagaaccttgcttgggattggggtgatgtcaccaaggagtgtatgaatggcatctggaagaagacactcaagaggtttgtccatgacttcaaaggatttgccaaggatgaggaggttgcaaaaatcaacaaggctgtggttgagatggcaaacaactttaacctgggtgtggatgaggatgacattgaggagctcctagaggtggttcctgaggaattgactaatgaggagttgttggaactggaacaggaatgcatagctgaagaagaggcaagagaaaaggaaactgcaggagaagaagaagaacccccaagaaaattcacagtaaagggtttagcagaagcttttgcagacctcaacaagctccttaaaaagtttgaaaacatggaccccaacaccgaaaggttttcattaatagagaggaatgttcatggtgcattatctgcttacaagcaaatctatgatgacaaaaagaaacaaaccaagcaaaccatcatggacatatatttctgaaaagagtgacacctcctcaagaagagcctcaggcaggtccttcaggagatattccagaagaargcatcgttatcataggagatgacagctccatgcatgttattgcccctgaagaccttccagtgggacaaaatgtggaggcggaagacagtgatattratgatcctgaccctgtgtaggcctaggctaatgtgtgtgtttgtgtcttagtttttaacaaaaatnttttaaaaaataaaaaaatwaaaaatttwwaaatagaaaaaagcttatagaataaggatataaagaaagaaaatatttttgtacagctgtacaatgtgtttgtgttttaagctaagtgttattacaaaagagtcaaaagttaaaaatgcaaaagtttataaagtaaaaaagttacagtaagctatggttaatttattgctgaaaaarwwwwwwwwwwwwwataaawttagtatagcctaagtgtacagtgtttataaagtctacagtagtgtacagtaatgtcctaggccttcacattcactcaccactcactcactgactcacccagagcaacttccagtcctgcaagctccattcatggtaagtgcyctatacaggtgtaccattttttatcttttataccgtatttttactgtaccttttctatgtttagatacacaaatacttaccattgtgttacaattgcctacagtattcagtacagtaacatgctgtacaggtttgtagcctaggagcaataggctataccayatagcctaggtgtgtagtaggctataccatctaggtttgtgtaagtacactctatgatgttcgcacaacgaaattgcctaatgacgcatttctcagaacgtatccccgtcgttaagcgacgcatgactg

SEQ ID NO: 14 - DNA, 335 bp, Homo sapiens
  repeat_region (1)..(335): golem_a
cagtcatgcgctgcataacgacgtttcggtcaacgatggaccacatatacgacggtggtcccataagattataataccgtatttttactgtaccttttctatgtttagatacacaaatacttaccattgtgttacaattgcctacagtattcagtacagtaacatgctgtacaggtttgtagcctaggagcaataggctataccayatagcctaggtgtgtagtaggctataccatctaggtttgtgtaagtacactctatgatgttcgcacaacgaaattgcctaatgacgcatttctcagaacgtatccccgtcgttaagcgacgcatgactg

SEQ ID NO: 15 - DNA, 1205 bp, Homo sapiens
  repeat_region (1)..(1205): golem_b
  misc_feature (347)..(347): n is a, c, g or t
  misc_feature (545)..(545): n is a, c, g or t
cagtcatgcgctgcataacgacgtttcggtcaacgatggaccacatatacgacggtggtcccataagattataatggagctgaaaaattcctatcgcctagtgacgttgtagtgcaacatatyactcaktactcacgcgtttgtggcgatgctggtgtaaacaaacctactgcgctgccagttgtataaaagtatagcacatacaattatgtacagtacataatacttgatagtgataataaatgactatgttactggtttatgtatttactatactatactttttattattattttagagtrtactccttctacttattaaaaaaaaaagttaactgtaaaacagnctcaggcaggtccttcaggagatattccagaagaargcatcgttatcataggagatgacagctccatgcatgttattgcccctgaagaccttccagtgggacaaaatgtggaggcggaagacagtgatattratgatcctgaccctgtgtaggcctaggctaatgtgtgtgtttgtgtcttagtttttaacaaaaatnttttaaaaaataaaaaaatwaaaaatttwwaaatagaaaaaagcttatagaataaggatataaagaaagaaaatatttttgtacagctgtacaatgtgtttgtgttttaagctaagtgttattacaaaagagtcaaaagttaaaaatgcaaaagtttataaagtaaaaaagttacagtaagctatggttaatttattgctgaaaaarwwwwwwwwwwwwwataaawttagtatagcctaagtgtacagtgtttataaagtctacagtagtgtacagtaatgtcctaggccttcacattcactcaccactcactcactgactcacccagagcaacttccagtcctgcaagctccattcatggtaagtgcyctatacaggtgtaccattttttatcttttataccgtatttttactgtaccttttctatgtttagatacacaaatacttaccattgtgttacaattgcctacagtattcagtacagtaacatgctgtacaggtttgtagcctaggagcaataggctataccayatagcctaggtgtgtagtaggctataccatctaggtttgtgtaagtacactctatgatgttcgcacaacgaaattgcctaatgacgcatttctcagaacgtatccccgtcgttaagcgacgcatgactg

SEQ ID NO: 16 - DNA, 704 bp, Homo sapiens
  repeat_region (1)..(704): gsat
  misc_feature (113)..(113): n is a, c, g or t
  misc_feature (268)..(268): n is a, c, g or t
  misc_feature (417)..(417): n is a, c, g or t
  misc_feature (449)..(449): n is a, c, g or t
  misc_feature (453)..(453): n is a, c, g or t
  misc_feature (466)..(466): n is a, c, g or t
  misc_feature (493)..(493): n is a, c, g or t
  misc_feature (547)..(547): n is a, c, g or t
  misc_feature (555)..(555): n is a, c, g or t
  misc_feature (597)..(597): n is a, c, g or t
gaattctgggagccttccaaggagggctttctcatcccagacgcccccatatctgttccgggcaggctataaagcccaaggctttggagcagggtgcctgtttctctccaaantcgcatgactgcaggtcgactctagaggatccccggcggaaggcccgacaagagaaacccgggccgcaggtggcgttggcgggccgaaggtactcaggatgacgttaaggcaggaagaggagagccacggtgagatcgcagagaatggtcagagncctccctagaaggccctctcccattccagaagccccccaggactttcccaggcagtgctgtaaagccaccaagctttggagccaaggtgactgtgtctcttgaggaagggcccgccacaaccaaaaacgttgcccgcctgatggcgtgnctggcctgcagggactcagggggatgtggagncagncagaaaggagaancaacgagactgcaggaaatgctaggancctcccaagaaggactttcttatcccaggagtttcaagggctgtcctggtcggnctgtaaanccccaggccttggaacagggtgcctgtgtctctcattgaagnccccaacaagagaaaacggtgctgcagggtggcgtgcgctggccgcagggactcaggaggatgttgagggagacagaggggtgaagcgttgagacgactgggaattc

SEQ ID NO: 17 - DNA, 1205 bp, Homo sapiens
  repeat_region (1)..(1205): gsatx
  misc_feature (34)..(34): n is a, c, g or t
  misc_feature (51)..(51): n is a, c, g or t
  misc_feature (380)..(380): n is a, c, g or t
  misc_feature (415)..(415): n is a, c, g or t
  misc_feature (459)..(459): n is a, c, g or t
  misc_feature (522)..(522): n is a, c, g or t
  misc_feature (553)..(553): n is a, c, g or t
  misc_feature (864)..(864): n is a, c, g or t
  misc_feature (975)..(975): n is a, c, g or t
  misc_feature (1017)..(1017): n is a, c, g or t
gaattccggatccaagtctactcttcagccttgntgattttttccttgggntgcctcaacctccccctgaaagtctggtgtcctgtaactgttcccctagggatatcttcccactttggggtgccccccatgggagaaacacacacccttggtgaaagccagggactccacgacccccttgggcccggctctggaactgctggaaaggcactggtctctggtagagtacaccagcctcctattcggactcgccacttttttcctccagctgcctcaatgtcaccctgaaatcctggcatcgtgaccacgtccctcggggacttcttgtcatgttgggcgggccgcctgtggggacagacacacacaccctgtgtgaaagnccaggggactccacaacccctgcagggcccagganaggagctgctgggaaggtactggcctccagtggaagacttcagncctccatttcagcctcgccgcttttttcctcaggctgcttcaacgtacccctgaaagcctggnatcctgtttcagtcactcgggatacttattnccactttggggagctcccccgtaggagagacatgcaccctgcatgcgtggcctgagaaaaaagtggtgaggacaaagaggagaccaggatgccccaccagaagacagcgctttcccggcagcccctgcgcatgacccaggtgggtggtggagtccctgaccccactaggggtgtgtgcctctcccacagaaggcaccacaaagcagcaagaagtcccccagggaacagagaaaggcagccaggctttcagaggggaggtttgaggcaggcttgggacaaaatagggaaggccaaaagaggacgcctgggtnccttcgccagaggtcagtgccttcctggaagctcccgagcccgatctgggggagtcctgacgtccctggccctcatgcagggtgcgtgtctctgccacagaaggcaccttnatgccgcaagaagtccccaggggacagagacaggcggccagnctttcagggggaggatgaagtaggcctgggacaaaagcggcgaggccaaacgaggtcagggtgccccacaggaggtcagggccctcctaacaacccctgcgcccaaaccgggggtgtcgtggagtccctggctcccaccaggggcacgtgtctctcccaccgaggacaccccaaagctgcaagaattc

SEQ ID NO: 18 - DNA, 2463 bp, Homo sapiens
  repeat_region (1)..(2463): hall
  misc_feature (391)..(391): n is a, c, g or t
  misc_feature (512)..(512): n is a, c, g or t
  misc_feature (645)..(645): n is a, c, g or t
  misc_feature (860)..(860): n is a, c, g or t
  misc_feature (881)..(881): n is a, c, g or t
  misc_feature (905)..(905): n is a, c, g or t
  misc_feature (907)..(907): n is a, c, g or t
  misc_feature (1252)..(1252): n is a, c, g or t
  misc_feature (1337)..(1337): n is a, c, g or t
  misc_feature (1392)..(1392): n is a, c, g or t
  misc_feature (1832)..(1832): n is a, c, g or t
  misc_feature (1881)..(1881): n is a, c, g or t
  misc_feature (1885)..(1885): n is a, c, g or t
  misc_feature (1935)..(1935): n is a, c, g or t
  misc_feature (2159)..(2159): n is a, c, g or t
  misc_feature (2161)..(2161): n is a, c, g or t
  misc_feature (2174)..(2174): n is a, c, g or t
  misc_feature (2334)..(2334): n is a, c, g or t
  misc_feature (2348)..(2348): n is a, c, g or t
  misc_feature (2350)..(2350): n is a, c, g or t
  misc_feature (2438)..(2438): n is a, c, g or t
  misc_feature (2442)..(2442): n is a, c, g or t
  misc_feature (2454)..(2454): n is a, c, g or t
aagatggcagattgaacatatacatttatttttctccctcccaaaaccccactaaaatgacaataaaggaattttttaaaagacataaacccacaaggacaaagagaacaggagaggagacaatagcaacaaaattttggaagctggaaagcagatggataagtggtaactgacttagcagacctgagaaagctgaatcctaagccagcagtggggaaagccaagaagcaacccaatttacaccgccagaatcctccccaaaaggctcaggaattggtggcaccaggtacctctggaagtgggggtgaaggtgaggctaaaaacagggaggattgattgaaagtctgtttaagaagcagttagatccccagattccctcccccactctatngcagccagataactgatcctcctccaccctagcagaagactggaggtttattctctggagaggataaaacaaaggggtctctggactggggaacaccaggcacagttgagggcagaggggnactgtactgaaaacaggggaattaagtgaaagtttacatactgaatgttgagactcccagccctcttcccccattcagctcccagaatgctggcagccaggcctataccctccagacaggagattagaagagntcttctctggagaatctgaccagcccaagagaaaagacttaaaaatactgataatagaggttccccaaacaaaatagcccagccagatcacccctatagtgaagcccacmacctggcaagccccacccacgcactcagagcttccaagtcgctttttagtstcccactcttaaatatgagcagacagccaaggatcaccagacatctgaggaaancctctaatatggcagacaganaaataaaaacagagaaaaacawwntntatccatgaaacaagaayaggatgctataaaaaggaacattcagagaacaaaaagaagctcttggaaattaaaaacgtgagagcagaaattaaaatttcaatagaagggttggaagataaagttgaggaaatctcccagaaagtagaacaaacaaaggataaagatacggaaaataggagagaaaagaattaaaaaaattgaggatcagtccaggaggtccaacatccaactaatagaagttccagaaagagagaacagagaaaaagatggaagagaaattatcaaagaaataattcaagaaaatttcccagaactgaaggacatgaatttccagattgaaaggncccaccgagtgcttaccgcaaaaatgaaggaaaaaaatagacccacaccaaggcacatcattgtgaaatttcagaacactgaganaaaaggaaaatcccaaaagcttccagagagaaaaaaaggtcacatacaaaggatnagaatcagaatggcatyagacttctcaacagcaacactggaagctagaagacaatggagcaatgccttcaaaattctgagggaaaatgatttycaacctagaattctatacccagccaaactatcaatcaagtgtgagggtagaataaagacattttcagacatgcaagatctcaaaaaatttacctcccatgcaccctttctcaggaagctactggaggatgtgctccaccaaaacgagggagtaaaccaagaaagaggaagacatgggatccaggaaacaggggatccaacacaggagagaggtaaagggaattcccaggatgatggtgaagggaaattccaggatgacagctgtgcagcaggcctagagagcaaccagtccagattggagcaggaagatggaaggctccaggaggaatgttctcaagaaaatagaanacaaatgaaactgatagattatctgatgtgtttgaatatattgagaggntatnatttagwcatgtgaaagtttgggggagaattgaattagtgataggtacanagaaaactaagcaaatgaaaaaaagcaagacaattattaactccagggaaaacaaaaagttgtacaagaaaggaaatgtaatcatagtacactacatggctcagctgtgaataacatatttacatagtcataataatgtaaacactraatactgatttaaccaaaattatgatataaactatattgggaggataagaaatggaaagggtgtgcgtatkgtgtangnggaatgaragaantaaatcctcatcttccatagtaggaagtcartagataatgtctaaaactgaaaaatcaagaaatagcaatataagcatgttatttagaaatatggaggtaaatattccaaaagaatcagctaaaagagttgaaagtggttgcctctggggaaggagctgnaggtggtgaagagngnagggacggggaaytgctgttttttataagccttttagtactatttgaccttttaaactatatacatrtattactttaatttaaaaaantaanttataaaaaagnaaataagta

SEQ ID NO: 19 - DNA, 8735 bp, Homo sapiens
  repeat_region (1)..(8735): herv15i
tttctggtggcccagatggggattggagacgacagatttactgtctcctttgcctgtgggactagagccccggggccgggggagacccggcatccaaggcgtgccacgggggagcttcacccggacggagaccggctctccccgcatcccggcggcctgcccggcagtgcaacggaaccggggatggggctgcaggacgataccagcacttcaggaaccgcggtaaggagcaagggcccaaggcaggaaagcccatcccatagggacgaaggggagcttgatcacctcccagggaccgaccactaatccaacccagagtggctgggggtggcaggagtggcctgccaatttggatgaacctcgtgtccccctaacaagtgaaagtggttcactggtggagaaaatgggccgatagagcggcaagtccagcaaggaagagcttgctggcagggtggcaagagtggcttgccaccccaactgggagtgtgtgggtgtgtgtggacctacccaggacatgagagaggctcgtttcgtccgatgaggagtcctggggtaggagtggtgtgtgtatgtgtgtgaatgtgggagcctaactaggctcacccgggacacgggagaggcctgtttcgtccgatgaggagtcctggggcaggraaggtgtgtgaaagagacggtctcgggagaggccaatgcggggagtaatgtggggaggcacagatcccttagcgcgggctgtgtgctccgaggcgagtgtgggggaaatcagacctaggacgttgcatatggctgataggaccagcttcacggccgcagcaggctgtgacaggggaaggcacattcctggctaagcagtgtccgaaactcccgtaataggacccggtctggtggacctgagagtgaaagtgagagggaaagtgcaccacaagggaggaaatgggaggaaaagcatcgaaaccaactcctttggagtgcatgataaagaattttaaaaaaggatttagaggtgattatgggatgaaactggatgctcaaaagttaaggacatactgtgaaatagattggcctgcttttaatgtggggtggccctctgaaggtacaatagacagggaattaattggccgtgtgtttaaggtggtcactggagttggaggacaaccaggatatccagaccagtttccctatatagactcttggctcagtgtggcacaaactcaccccaagtggctacagccctgcctagagggatattgcaaggcattagtggctcaggcagcccaaccaaaggaagcagaggaacctaaagcccctagagtctctcaggaaaaggaatccctgaagcctcagctgaaaccagttcttcaggctccacctgaggaaagggaatgtccgcccccatatatgtgccagtctacctgtctttggccagaataaggcaggaggcagagtcaggagcatccacagagtcaggctgagaggaaagtgaggcccagtctcccccaaccccagaggaacaaaagcctcccttagaaaaaaaccaggaagatggacagagcaaggcagctgggtgcctccgctcaggctgaccacaggctttgcagatgccacttcgagagaacaggacacaagtttatgatgaccaagggcagatacaaggaggctctaggctttatgtttatcagcctttctccactactgatctcttaaattggaaacagcacgcccccttgtatgcagaaaagcctcaggctgtcattgatttggtgaattctattattataacacaaaacccaacctggccagattgtcaactacttttgctaactttaatacagaggagcataggagagttaatcaggcagctctcagctggttagaaggggaagccccagaggccacccgtaacccatgccagttctccgtggagcgatacccaaatgaggaccctaactgggacccaaatgaggcaggggacatggaacagctgcattatatagaagggcactcctgaacaggataaaagcaggaggaaggaaggcattgaatatccataacatatcagaagtgggccaaaagcctgacgaaagccgcagtgcattctatgaaaggctttgtgaggcatagaggctgtacactccaattattccagaggctcctgaaaaccaaaatatgataaatatgacctttgtcaggcaagctcagggagacataatacgaaagcttcagaagttggaaggcttttcagggaaaaatattagtaaactcctggaaatagcaaacaaagtattaaaaaactgggaagaagaggcagagaaaaaggaagaaagaaaaacgagaaatagaaacaaagagacagctcaatttctgctgcactagcagaaagtaaccctggatttgctagagggcgtggccgaggcagaggccaaggaacagggcagacaagacccggagatgaaagccagtcccagttggacaggaatcaatgtgaaaggtgcaggcaaatgggccactggaaagatgagtgccccgaaaaggaaaaggatgatgatggtcagtggtctaacacccaagtgcggtgttaggttgctagcagtggtacttccaaggcagatcccgatctgatcggcttggcaggggccgagaatttagaggactcagacagaccaggctccatccttttaggccttgtggagcctatggtctctatggaagtagggggccgattaatgaatggattttttggtcaatactggtgctgatttctctgtggtaactcacccaattagccccccctcaaagaactgtgctactatcgtaggggctacagaggccaaagaaaagagacctttttgcaattccaggagatacgttattgggggacaagaagtgcagcatgagtttctatatatgccaaattgtccagtgcccttgttggggagagacttactccagaaactgcaggcacaaatttcctttacacctgaagggaatacgacaccggaatttggaaagtctaaggcaatggtattgattctaactgtcccagaggctgaggaatggcagctctctgaactgtgtgccagaaggataccggagctggacctacacagtatgtagggaatgcttttcaaggttccaggtgtatgggctgaggacaatcctcctggacttgctgtaaacagacacccagtggtaatagagcttaacactcatgctgccctggtatgagtctgtcaatacccactacccaaagaggtaattgaaggcataacacaacatctaaatcggctctatgaacaagggattatagtaaaatgcaagtcctcttggaatactcctctgcagcctgtgcacaagccaaatggtgaatacaggccagtgcaggacttctgggtggcaaacaaggccactgtcactatctatgccatagtacccaacccatacaccatgttaggacagattcctgctgaggccatgtggttcatgtgtctagacttaaaggatgttttctttgcttgagacttgctccccaaagtcagcctatatttgccttccagtgggggcaattgtaatatacctggacaagactgccacaaggatttaagaattctcccattatctttgaggacgctttggctaccaaccttgaagcttttgcaccatttagtgacaattctgtggtattacaatacattcatgatttgctattcgctgcccccaggagggaggaatatctccaaggaatagagaggcttcttcacctgctgtgtgaagctggttacaaagtgtccaaggacaaggcaaaagtctgttttctggaggttggatatctaggattcatggtatcccaaagcctgcacaggcttggaagtgcatgcaaggaggctttatgtgcattgcccacctcagttacaaggcagcaggtcagggaatttctgggtgcagtgggattgtgccgaatctggattccaaacttctcccttatagcaaggcccttatttgaggctagcaaaggaaaggaaagagagcccctcctatgggaaaaagaacaggaaaaggccttcaaggatataaaggaagctctcatccaggccccagcactagggttgccagatgttaaaaaacccttctttttgtatgtggatgaatgaaagggaatggtatttggagtcttaactcagttgttaggctcttggcatcagccagtagcatacttttatccaagagactggacttggtggccttaggttggccccattgcctcagggcactggcagctaccgcgatccttatagaagatgccaacaagctagccctaggtcagaagataatattccgggtgccacacactgtagtcaccttaatggagcaaagaggacgtcgttggctgtcccactctagaatgctaaagtatcaagggcttctgtgtgagaatctgcgggtaacactacagactaaataccttgaacccagctaccctgctgcctgtggaggaacccgattggaagcatggtgggttgcctcaatgctggcaggaccttccccactgttgcataaatatggtggatgaagtgttcttgagctgggaagatctcagagatacccccttggagagcccagatgttgaatacttcactgatggtagcagtttcataacagatggggtgtgatatgcagggtatgcagtagtaacacaacactcagtagttgaggctcaagccttaccttctgggacttccgctcagaaggctgaattaatagcattaaccagagcactgttattggccaagaggaagaaagtaaatatatatactgactcaagatatgcttttgcaaccctgcatgcccatggggcaatataaaaagagagaggactattgactactgaaggaaaagatataaaaaataaagaagaaattttgcaattattagaagacatatgggctccagagaaggtggctgtcattcattgcaaagggcaccaaatcaggaaaagctatgaggcacagggcaacagaaaggcagaccaagaggctcagcaggcagcaatgagcaaggttttacctgaagaaagaactccagcaatgcctctccttatagagccccctttactggaggtacccaattactcttcaagtgaaaaagcttgttttcatcaggaaacaggaaacatatattaaagatggttggtggctgttctctgacgggaggctagccatcccagaaacaatagccccaaggtttgtgaagcagatccatcaaggaacacacattggaaggacggccctagagactttgataggtcagcatttctatgtgccatggctgtctgccatcacccatgctgtttgtgaacaatgtctatcctgtgtccggaataatccaaaacaaggacctactcgacccccaggaatacaggaaatgggagctgtgccttgtgagaacctgcttgtagactttaccgagttacctcgagcaggaggttaccggtatatgctagtgtttgtttgcaccttctcggggtgggttgaggccttccccaccaggactgaaaaggcacgagaggtgacaaaggtgctactaaaagacatcataccaagatttgggttgcctttaaccctaggatcagacaatggtcctgcatttgtggcagaagtagtacaacagttgactcaacttttaaagatcaaatggaaactgcacacagcctactgaccacagagttcagggaaggcgraacggatgaaccagacactcaaacagctactaaaaaagttttgccaggaaactcacttacaatgggatcaggtcttgcccatggtcctcctccaggtcaggtgtacacctacaaaacaaactgggtatttgtcctatgaaatattgttcggaaggccacccccaatcattaatcaaattagaggggatttaaaggagttaggagagttaacccttaagagacagatgcaggctttaggagtggcaatgcaggaggtgcaaagctrggtaagagaaaggatacctataagtctaacagacccagtgcatccacataagccgggggactctgtctgggttaaaaggtggaatccaacaaccttgggacccttatgggatgggccccatattgtaatcatgtctactcccactgctcttaaagttgcaggtgtcacaccttggattcaccatagctggctgaaaccagcggcagcagtgactcccgatgacgaccagtggattagccaacaagacccagatcgccccacctgaatagtcctacggcgaaacccaaccaccggtaagaaggacaactgccctgctccgaccacaccggaggctggtcagtctacgcatggctgaagcttgaagatcctgcaagctctgctctagtcacatcccggaagctgactagtcaatgcacagccgaagctaagaggaccatctctggataagtaaatgtggatacaattcataaccctagttataattctgttaatactgattgttctgttgttacgttaccactgcaaatgctgcaaatgtctatgcccagagggaggtttgccatgcccatgtgtagtgtaagcatgtttctattacatacactgatgttgttaccatttctgcctatactaaaaggggaggaatctctagaaagatgcccacactgtgtacatactacctgggtaaggaataccatagttaaaactctactgtaccatacctacagtacaggaaccaagttaggaacctgcgcatacaaccagaccacctcttcagtctgtgacccaggaaataatcagctacatgcatgttatgaccctaagcgcttaccctatgaattctggtttgaggtacatattaaatcagagggagaaaaagaaggagagcttatagctcgaaccaaagaagcccctccctcctataaaaggcctatttccttgtactttgatgcctgccatgccgcatatgttcataatcctaaaaaaccaaaagcagtctgcaatggtttaacacaagagaggcttagcaggagcagccctaaacatctgtactgagaaccacaaattggatgcccagactgtaacattcagtggtctatgctaacacagctccaacacttatattcaggaaggactgctctgctaagtagtatgtcagccaaaccaaattgtaagacaaggacatgcaatcctttaaattttactatcttaaagccagagctacctttctggtctacaggacagacagcactattacgagttgatagacaaggagcaggccttggagttccactactaattgtcaaaaagactagaaggactcaaatgtgtccaaccctgcaattctgggtccataagtcattctgtaagcattttgatcagtcagtgcctgagcttcccctatcaaccaaaaacttatttgctcaactagctgaaaacatagctggcagcttaggaatttcctcatgctatgtacgtggaggaactaatatggggaaccagtggccatgggaggcaaaggaattaatgccacaagataacttcacttcgcctaaccctgccagtgaaccaacagcctcagccagtgtttggttgttaaaaacctccataattggaaagtactgtatcgcccgttggggaaaggctttcacagaggcagtaggagaaacaacctgcctagggcaacagtattatgatgagactaaaaacaaaactctatggagaaacacccagaattactcctacttaccagatccaaatcctttctcttgattctctaccctaagccacacttggcatcagctagaggttccaaatgcttggaaagcaccctctggcctatattgggtctgtggagcatgggcatatcggcaactgctggctaaatggacaggggcatgtgtgttagaaacaatcaagccatccctctttttaattcctctaaagcaaggggaactcttagggtatccagtttatgatgaaaataaaagaactagaaaaagcataatcacaaaaatagacacaaatgtcaaaaaggatgcagacataggagactggaaggataatgaatggcctcctgaaagaatcattaaatagtatgggcccgctatctgagcgcaagttgggtcatgggaataccgcaccccaatctatatgctcaaccgcatcataaggttgcaggcagtccttgaaataataaccaatgaaatgtcaaggaaactagatttattgataacacaagcaacacaaatgagaaatgctacatatcagaatagattggctttagattacctcttagcctcagaaggaggagtatgtggaaaatttaatttaaccagttgttgcctagaaatggatgataatggccaagctctaatggaaaccacagctagaatgtccaagttggcccatgttccagttcagacttggtctggatggtccctggattccttgtttggaggatggttctcaatgtttgggggattcaaaaccctcattggtgggtttttgtttattcttggcatctgcctcatcctcccttgccttttacccctgtatattaggagtatttgtcaactatagaggcagtagtaacccgaaacactaccatgctattgacggcattaaccaaatatcagccactgccaataaaagaaacagctcagctccgggaagagatggcaaatagtggtgctttctattaacatctttgttttaaaaagcaccaaaggggggaaa

SEQ ID NO: 20 - DNA, 4996 bp, Homo sapiens
  repeat_region (1)..(3596): herv16
  misc_feature (71)..(71): n is a, c, g or t
  misc_feature (99)..(99): n is a, c, g or t
  misc_feature (252)..(253): n is a, c, g or t
  misc_feature (421)..(421): n is a, c, g or t
  misc_feature (516)..(516): n is a, c, g or t
  misc_feature (677)..(677): n is a, c, g or t
  misc_feature (712)..(712): n is a, c, g or t
  misc_feature (812)..(812): n is a, c, g or t
  misc_feature (1249)..(1249): n is a, c, g or t
  misc_feature (1424)..(1424): n is a, c, g or t
  misc_feature (1496)..(1496): n is a, c, g or t
  misc_feature (1522)..(1522): n is a, c, g or t
  misc_feature (1565)..(1566): n is a, c, g or t
  misc_feature (1683)..(1684): n is a, c, g or t
  misc_feature (1845)..(1845): n is a, c, g or t
  misc_feature (1951)..(1951): n is a, c, g or t
  misc_feature (2102)..(2102): n is a, c, g or t
  misc_feature (2108)..(2108): n is a, c, g or t
  misc_feature (2117)..(2117): n is a, c, g or t
  misc_feature (2274)..(2274): n is a, c, g or t
  misc_feature (2392)..(2392): n is a, c, g or t
  misc_feature (2459)..(2459): n is a, c, g or t
  misc_feature (2564)..(2564): n is a, c, g or t
  misc_feature (2568)..(2568): n is a, c, g or t
  misc_feature (2572)..(2572): n is a, c, g or t
  misc_feature (2628)..(2628): n is a, c, g or t
  misc_feature (2648)..(2648): n is a, c, g or t
  misc_feature (2654)..(2654): n is a, c, g or t
  misc_feature (2791)..(2791): n is a, c, g or t
  misc_feature (2809)..(2809): n is a, c, g or t
  misc_feature (2813)..(2814): n is a, c, g or t
  misc_feature (2926)..(2926): n is a, c, g or t
  misc_feature (2928)..(2928): n is a, c, g or t
  misc_feature (2930)..(2930): n is a, c, g or t
  misc_feature (2982)..(2982): n is a, c, g or t
  misc_feature (2988)..(2988): n is a, c, g or t
  misc_feature (2993)..(2993): n is a, c, g or t
  misc_feature (2995)..(2995): n is a, c, g or t
  misc_feature (2997)..(2997): n is a, c, g or t
  misc_feature (3004)..(3004): n is a, c, g or t
  misc_feature (3019)..(3019): n is a, c, g or t
  misc_feature (3075)..(3075): n is a, c, g or t
  misc_feature (3092)..(3092): n is a, c, g or t
  misc_feature (3097)..(3098): n is a, c, g or t
  misc_feature (3097)..(3130): n is a, c, g or t
gttggtaccaggagtggtccgagaaagcagacgmtgctaagatgkgattttggagttggatcacccgctgncwagctggcaatgaggactccatcacwngtggtaggtggagcatagatagcctctggcacaaggtagtagtgsaattgttaaaactttcactggtggtgaactgggatggcgtactggtgaaaagagaacgcactagctggtgcaatgcttcaggcgtttgagaaatatgggatgaattanntacatggaaggacartggaattggatggctgtcgctaagcttgactgacactctgkaaaagaacaataaaragctgagagcgattaattggcaattgaaaactaagcatgaaagccagagggcctctttggtagcatataaagaggctctcatctcctgcagcggganggcagagaaasctgaggatcagacccagaatttgatcaaagtagcaaagcttcaaagaaggttaaattcccaaccaaggcaggtcttctatgccnagktcagcgccccggttaggsaagaacgggaccctgacacacggratggggacgtctggattgatgcccctaaaaatcttgaatccccagattcccctgaaccctttgagcctgcagaagtgacctactcctccctattaagggctrgcattcgcttcttnctttatgggaagacagtacggaggcctctcccttngcaagacaacatgggttttccycaggatctgcctccacctcatctcctggccactaggccaataactagggttaartcacarcgtaacctggccggggangtgctgggcctgataaggaaagaaagggactataccccaaaggagttgcgggacatatctagccagcatatactagcaggaccgggagagtacsyacgggactggattctgaggacgcttgatcaagggggccggaacataaakttggataagggagagtttattgatttgggagcactctcccgggatacaggatttaacaccctggcgaggaccccaggagatggcgcaaacacactgctaggatggctcctagaagcatggagaaagcgatggctcacactaagtgaggtagaaatgccagaattgccatggcagatggtgaaaaaagggatcaaaaagctcagggaggtgggcatgctggaatggatatattatgtraggccagaagacccgccagaggattatgttstacaggaggactcaggggacgcacnatttaccaaagccataaggaatgtgctggwgagaggggcgccagcatcaccgagaagttcaatggtggctctcytctgcaggccagggttgataataggagaggcaatcacagagctgggctcgctgatagcagtcggggtgatagggctctgacgtaatagaggccaggtggtngcactcggccgtcagaagcaaggtggacgtaaataccacaatgcactgcagggtcggagtggcagtcggganggcctgacttgcggggagctatgganatggttaatagaacacagtgtccctagaggcgaaatagacggnnagccaacaggaagacatggacagtcaatgggacatggtgtcctatgggcaagagagatgggctgccaacaagggtgtattgttcaactgaagcaagcgaaagaaacgaagggtgtannactaggaggctgagggcggtcgccccaataaaaagtcatratcccttgcccagtttccagatctgagccagttttcagacctagaacccattgactgaaggagaggccgggtccccaggaggaaggaccccgcaacaccacggcaagtgtacatcgtaatnatttctccagtccttccccaargggacctgtrgccatttactctgggtaactatgcaccggggaaagagaaatacccggacatttcgaggactattggacactggntctgagttgacattgatacccggagacctaaagtgtcatcatggtcctcccgttagaatgggggywtatgggggycaggtaataaatggaatcctggcccaagtctggctcacagtgggtccactgagttcacagacccacagtggttatntctctnatccctgantgtataattgggatatacatacttggtagttggcacaacccctacattggktccttggcctgcggggtgagagctatcatagtggagaaggccaagtggaagcttccgaaactgccctcaccttctccgggcaagacagtaaatcaaaaacaatatngcatcctcggggtggagaatggcagaaattattgccaccwttaaagacctaaaggatgcaagaggtgtggtctccatcatatcttcgtttaattcgccagtgcaaacccctgcaaaanctagacggatcctggatgacggtagcgggctaccacaaactcagccaagtagtatcccaattgcaantgctataccagacgtggtatcttcgctacagcagattaacatggcctcaagtatgtggtktgtagctattgatktggtaaatgtattcttttccatctctgtcanaaanaacnatcagaagcagtttgcattcactcggaacggacaacagtatacatatacagttttncctcagggcactactaactntcatgncctctgtcataatatagtctgaaggggtctgaaccacttggacatcctacagaacatcacattggtccactatgttgatgacatcatgctaattggaccggaataagcaggaagtggctagtacattggaggccttngtaagrcacatgcgctcnaganngtggaagataaaccctacgaaaatccgggagcttgccacatcaatgaartttttaggggtccagtggtctgkggcatgccggaatatccccccaaagtaaaggacgaattantntntcttgtaccttccaccacgaagaaggaagcgcaatgcctggtaggcctcttngggttntggananancatattncacacttgggaatantgttccgacccatatactgggtgacgcgaaaagctgccagctttgagtggggcccnagcaggaaagggctctntggcnnnnnnnnnnnnnnnnnnnnnnnnnnnnnnnnnncctctaagtcataaagtaagatgaatccagcagtagcccataatacggtggaaacagaatatcctagattaagtccgaggaaaaccagaggacacaggttaggtatatgagcagatagcccagatccccatgctatccaccacagttgcaccagtgcctctcctttggtttgaacctatagccatattaaagtatgtggtcccatataaccagttgaaggaaagctcaagcttggtttacaggatcagcttggtatgtgaacgtaagtcaaaatacgtggtgactgtattacagccccatttagaggtggtcctgaaaggcagcagggagtgaaaatattttcccagtgggtagaactgcaagcagtgcacctgattatccactttttgtggaaaaagaagtggtccaagatggtaatatatatgcattattggacagtagccaaaggtctggtgagctggtcaggagcttggaaggaaaagatcagagaaagggaagtctagagtagaggcatgtggatagacatattggaagtgatatgaaataggaagatttttgtatcaatcctattttaatgttcacatgaaagcatcaattgtgaaagagtaactgaagaactaagtagacaaagcgactttgaccactgacattaaccagcattcattctggccttctcaggactggtccaatagacatctcaaagaactagccatggcagaagaaatggaggtaatatatgggcccaatatcacagactcctgtgtaccaagacaatttagctgcttccctgtatgaatatccaacctgcagcaacagcgaccaaggctctatctcaaatacgacactatttatgaagaccacttagcagtgaattgactatattgtatgctttttatcctggaacagtcagtggttcatgctcacagaactatgtacctattctgggtatggatttgccttttctgcctgcacagcctcattaagcatctgagggatttgggggttcttgagccatagtctcggaatcccacacaacagagcatctggacagggtagtcacttcatagtaaagaaggggcacaaatgggtccagaacaagaggatccacttatcatatcaaatactgcaccatccagaaggagctgacctcacagaacacttctgaaggcaaagataaagcaccaataaaagtaaaccctgaaaaaattgggtgccgttctccaggatgcagtgtatacattaaatcacagacctatacgttaggctttagatctaattggaagaatgggattaggaataagaggtgaaagcaggagtgtgcctactccccatcgtagtggcccacaaggatcacagcagtggtttgaacacggattggactactgatatccaggaatcgccgcacaagaaggggaatccacatgtggcaggagtaattgactatgatgtgtaggaggggtagggctgctttagtaaaatgagtaagaaaggaatacatatgaaaccaggtgatctacttgagtgcctcctggtattctcttgcttcatttaactgtgaatggataatgtcattgaaaagagtttggacacctccacaatgaaagtttggttcacatggctaagtaagcttccaagacttgtcaaaataataactgtgtgagggacatttcaaataggtagtggaaaaggaagataataattaccagttctggcccagaaactaaatgcagcaaggggggctgtagtgtgtcccactatcctccctcttcaaagtttggcttcataaagagaagcttaaaggaataaggaaggaactgttccatgaacctgaatggagaaatagatctgtcgagtacaaaggtggac

SEQ ID NO: 21 - DNA, 8523 bp, Homo sapiens
  repeat_region (1)..(8523): herv17
ttttggcaaccacgaacggacatccaaagtggtgagtaatattggaccactttcacttgctattctgtcctatccttccttagaattggaggaaaataccgggcacttgtcggccagttaaaaacgattagtgtggccaccggacttaagactcaggtgtgaggctatctggggaagggctttctaacaacccccaacccttctgggttggggacttggtttgcctcaagccagcttccactttcagttttcttggggaagccgagggccgactagaggcagaaagctgtcgtcctgaactcccggcagtagccggttgagatcatggtgtagccagaagtctcaacagtcgcccatgcatgcacccctatctttccttctgacccatacctcctgggtcccaaccacaactttcttcaaagtgtagccccaaaattctccttacctctgaatatacttcctctgatccctgcctcctaggtactattggttcagacttccatttcctctagcaagttgtatctccaaagggatctaaggaagctctgcgctgcgtccttaggcacctaggctataacccagggagtcttatccctggtgtccctcccaatttaggcatacagctcttgacatgggcagttatgtaggacccactccccaccacccttgccagggccccaagtttgtaaatggctgagggaaaagagagacagaggagagagagagaaatggaggagaaagagagagagacagagaggagagagagacagtgagagagacagaagagagagagagacaaagaggagagagagagagtcaaagagagaaagaaagagaaagaaatagtaaaaaacagtgtgccctattcctttaaaagccagggtaaatttaaaacctgtacttgataattgaaggtcttctctgtgaccctatagcactccaatccactttgtggtcagtgtaaataagagcataggccgaaagcactgaggccattgacaacccgtagcttccctatcaaaaatccttaacccagtaacccgcagatggaccaaatgcattcagtcggtagcgcaactgctttgctaaaagtagaaaagtaacttttagaggaaacctcattgtgagcacacctcacctgttcagaattattctaataaaaaaagcaaaaaggtagcttactaactcaaaaatcttaaagtatggggctattctgttagaaaaaggtaatgtaactccaaccactgataattcccttaacccagcagatttcctaacgggatttaaatcttaattaccatacaaaggtccgaccagacctaggcggaactcccttcaggacaggacgatagatggttcctcccaggtgattgaggaaaaaaaccacaatgggtattcagtaattgatacggggactcttgtggaagcagagttagaaaaattgcctaataactggtctcctcaaacgtgtgagctgtttgcactcagccaagccttaaagtacttacagaatcaaaagactatctcaatcctgattcaaaaggttagctacaccctctctgtaatgcatttgcataagaacttgtttatgggaatgcatcttgatggggcagctgggttgttataaaataggaacccagcccagctctagaactcacccctgagcacaaaggcaatgttgggcacgctggtaaaggaccactagaatccagcagcctggacccctttctttgtggtcaagagaggcaggaaaacaggtgcaggactgcaacatcagtgagcataactaattcgataagcagaggtccatgggtggtgatgcaccctggaaagaataagcattaggaccatagaggacactccaggactaaagctcatcggaaaatgactagggttgctggcatccctatgttcttttttcagatgggaaacgttccccgcaagacaaaaacgcccctaagacgtattctggagaattgggaccaatttgaccctcagacactaagaaagaaacgacttatattcttctgcagtgccgcctggcactcctgagggaagtataaattataacaccatcttacagctagacctcttttgtagaaaaggcaaatggagtgaagtgccataagtacaaactttcttttcattaagagacaactcacaattatgtaaaaagtgtgatttatgccctacaggaagccttcagagtctacctccctatcccagcatccccgactccttccccaactaataaggaccccccttcaacccaaatggtccaaaaggagatagacaaaagggtaaacagtgaaccaaagagtgccaatattccccaattatgacccctccaagcagtgggaggaagagaattcggcccagccagagtgcatgtgcctttttctctcccagacttaaagcaaataaaaacagacttaggtaaattctcagataaccctgatggctatattgatgttttacaagggttaggacaattctttgatctgacatggagagatataatgtcactgctaaatcagacactaaccccaaatgagagaagtgccaccataactgcagcctgagagtttggcgatctctggtatctcagtcaggtcaatgataggatgacaacagaggaaagagaatgattccccacaggccagcaggcagttcccagtctagaccctcattgggacacagaatcagaacatggagattggtgctgcagacatttgctaacttgtgtgctagaaggactaaggaaaactaggaagaagtctatgaattactcaatgatgtccaccataacacagggaagggaagaaaatcctactgcctttctggagagactaagggaggcattgaggaagcgtgcctctctgtcacctgactcttctgaaggccaactaatcttaaagcgtaagtttatcactcagtcagctgcagacattagaaaaaaacttcaaaagtctgccgtaggcccggagcaaaacttagaaaccctattgaacttggcaacctcggttttttataatagagatcaggaggagcaggcggaacaggacaaacgggattaaaaaaaaggccaccgctttagtcatgaccctcaggcaagtggactttggaggctctggaaaagggaaaagctgggcaaattgaatgcctaatagggcttgcttccagtgcggtctacaaggacactttaaaaaagattgtccaagtagaagtaagccgccccctcgtccatgccccttatttcaagggaatcactggaaggcccactgccccaggggacaaaggtcctctgagtcagaagccactaaccagatgatccagcagcaggactgagggtgcctggggcaagcgccatcccatgccatcaccctcacagagccctgggtatgcttgaccattgagggccaggaggttgtctcctggacactggtgcggtcttcttagtcttactcttctgtcccggacaactgtcctccagatctgtcactatctgagggggtcctaagacgggcagtcactagatacttctcccagccactaagttatgactggggagctttattcttttcacatgcttttctaattatgcttgaaagccccactaccttgttagggagagacattctagcaaaagcaggggccattatacacctgaacataggagaaggaacacccgtttgttgtcccctgcttgaggaaggaattaatcctgaagtctgggcaacagaaggacaatatggacgagcaaagaatgcccgtcctgttcaagttaaactaaaggattccacctcctttccctaccaaaggcagtaccccctcagacccaaggcccaacaaggactccaaaagattgttaaggacctaaaagcccaaggcctagtaaaaccatgcagtaacccctgcagtactccaattttaggagtacagaaacccaacagacagtggaggttagtgcaagatctcaggattatcaatgaggctgttgttcctctatagccagctgtacctagcccttatactctgctttcccaaataccagaggaagcagagtggtttacagtcctggaccttcaggatgccttcttctgcatccctgtacatcctgactctcaattcttgtttgcctttgaagatacttcaaacccaacatctcaactcacctggactattttaccccaagggttcagggatagtccccatctatttggccaggcattagcccaagacttgagccaatcctcatacctggacacttgtccttcggtaggtggatgatttacttttggccgcccattcagaaaccttgtgccatcaagccacccaagcgctcttcaatttcctcgctacctgtggctacatggtttccaaaccaaaggctcaactctgctcacagcaggttacttagggctaaaattatccaaaggcaccagggccctcagtgaggaacacatccagcctatactggcttatcctcatcccaaaaccctaaagcaactaaggggattccttggcgtaataggtttctgccgaaaatggattcccaggtatggcgaaatagccaggtcattaaatacactaattaaggaaactcagaaagccaatacccatttagtaagatggacaactgaagtagaagtggctttccaggccctaacccaagccccagtgttaagtttgccaacagggcaagacttttcttcatatgtcacagaaaaaacaggaatagctctaggagtccttacacagatccgagggatgagcttgcaacctgtggcatacctgactaaggaaattgatgtagtggcaaagggttgacctcattgtttacgggtagtggtggcagtagcagtcttagtatctgaagcagttaaaataatacagggaagagatcttactgtgtggacatctcatgatgtgaatggcatactcactgctaaaggagacttgtggctgtcagacaactgtttacttaaatgtcaggctctattacttgaagggccagtgctgcgactgtgcacttgtgcaactcttaacccagccacatttcttccagacaatgaagaaaagataaaacataactgtcaacaagtaatttctcaaacctatgccactcgaggggaccttttagaggttcctttgactgatcccgacctcaacttgtatactgatggaagttcctttgtagaaaaaggacttcgaaaagtggggtatgcagtggtcagtgataatggaatacttgaaagtaatcccctcactccaggaactagtgctcagctagcagaactaatagccctcacttgggcactagaattaggagaagaaaaaagggcaaatatatatacagactctaaatatgcttacctagtcctccatgcccatgcagcaatatggaaagaaagggaattcctaacttctgagagaacacctatcaaacatcaggaagccattaggaaattattattggctgtacagaaacctaaagaggtggcagtcttacactgccggggtcatcagaaaggaaaggaaagggaaatagaagagaactgccaagcagatattgaagccaaaagagctgcaaggcaggaccctccattagaaatgcttataaaacaacccctagtatagggtaatcccctccgggaaaccaagccccagtactcagcaggagaaacagaatggggaacctcacgaggacagttttctcccctcgggacggctagccactgaagaagggaaaatacttttgcctgcaactatccaatggaaattacttaaaacccttcatcaaacctttcacttaggcatcgatagcacccatcagatggccaaatcattatttactggaccaggccttttcaaaactatcaagcagatagtcagggcctgtgaagtgtgccagagaaataatcccctgccttatcgccaagctccttcaggagaacaaagaacaggccattaccctggagaagactggcaactgattttacccacaagcccaaacctcagggatttcagtatctactagtctgggtagatactttcacgggttgggcagaggccttcccctgtaggacagaaaaggcccaagaggtaataaaggcactagttcatgaaataattcccagattcggacttccccgaggcttacagagtgacaatagccctgctttccaggccacagtaacccagggagtatcccaggcgttaggtatacgatatcacttacactgcgcctgaaggccacagtcctcagggaaggtcgagaaaatgaatgaaacactcaaaggacatctaaaaaagcaaacccaggaaacccacctcacatggcctgctctgttgcctatagccttaaaaagaatctgcaactttccccaaaaagcaggacttagcccatacgaaatgctgtatggaaggcccttcataaccaatgaccttgtgcttgacccaagacagccaacttagttgcagacatcacctccttagccaaatatcaacaagttcttaaaacattacaaggaacctatccctgagaagagggaaaagaactattccacccttgtgacatggtattagtcaagtcccttccctctaattccccatccctagatacatcctgggaaggaccctacccagtcattttatctaccccaactgcggttaaagtggctggagtggagtcttggatacatcacacttgagtcaaatcctggatactgccaaaggaacctgaaaatccaggagacaacgctagctattcctgtgaacctctagaggatttgcgcctgctcttcaaacaacaaccaggaggaaagtaactaaaatcataaatccccatggccctcccttatcatatttttctctttactgttcttttaccctctttcactctcactgcaccccctccatgccgctgtatgaccagtagctccccttaccaagagtttctatggagaatgcagcgtcccggaaatattgatgccccatcgtataggagtctttctaagggaacccccaccttcactgcccacacccatatgccccgcaactgctatcactctgccactctttgcatgcatgcaaatactcattattggacaggaaaaatgattaatcctagttgtcctggaggacttggagtcactgtctgttggacttacttcacccaaactggtatgtctgatgggggtggagttcaagatcaggcaagagaaaaacatgtaaaagaagtaatctcccaactcacccgggtacatggcacctctagcccctacaaaggactagatctctcaaaactacatgaaaccctccgtacccatactcgcctggtaagcctatttaataccaccctcactgggctccatgaggtctcggcccaaaaccctactaactgttggatatgcctccccctgaacttcaggccatatgtttcaatccctgtacctgaacaatggaacaacttcagcacagaaataaacaccacttccgttttagtaggacctcttgtttccaatctggaaataacccatacctcaaacctcacctgtgtaaaatttagcaatactacatacacaaccaactcccaatgcatcaggtgggtaactcctcccacacaaatagtctgcctaccctcaggaatattttttgtctgtggtacctcagcctatcgttgtttgaatggctcttcagaatctatgtgcttcctctcattcttagtgccccctatgaccatctacactgaacaagatttatacagttatgtcatatctaagccccgcaacaaaagagtacccattcttccttttgttataggagcaggagtgctaggtgcactaggtactggcattggcggtatcacaacctctactcagttctactacaaactatctcaagaactaaatggggacatggaacgggtcgccgactccctggtcaccttgcaagatcaacttaactccctagcagcagtagtccttcaaaatcgaagagctttagacttgctaaccgctgaaagagggggaacctgtttatttttaggggaagaatgctgttattatgttaatcaatccggaatcgtcactgagaaagttaaagaaattcgagatcgaatacaacgtagagcagaggagcttcgaaacactggaccctggggcctcctcagccaatggatgccctggattctccccttcttaggacctctagcagctataatattgctactcctctttggaccctgtatctttaacctccttgttaactttgtctcttccagaatcgaagctgtaaaactacaaatggagcccaagatgcagtccaagactaagatctaccgcagacccctggaccggcctgctagcccacgatctgatgttaatgacatcaaaggcacccctcctgaggaaatctcagctgcacaacctctactacgccccaattcagcaggaagcagttagagcggtcgtcggccaacctccccaacagcacttaggttttcctgttgagatgggggac

SEQ ID NO: 22 - DNA, 6053 bp, Homo sapiens
  repeat_region (1)..(6053): herv18
atagtcagcaggatcccgaggtgagtgagccttcggcccccgatgatcccgggtcggccatgtggccgcagcatgggttgtggtacccggtggcagctgtgctgctaggatgggctccagtggaaacatgggcggcggtggacgggtcccccatgagcgtggagaaggcgctgaagcacctggaagcgcagagcaccgagaaggagcgtgcctttgccggcagagtcggatgggcatttttgactgtgctacaggaagtacatgctcagtccctgcgggatgcagcacaggtaagggacctccaggcgcaagcggagcgcctggaggcccagatacacagcttggaaaaagacctggrggtaagggacctccaggcgcaggcagggcgcttggaggcccagctacacagcttggaaaaggaattagaggctgccgtgaatgcaggcctgggcccgtcatcccggccagagacccccactcggtctgataccgaggaggaagaacccccgttgcgggctcacccagtggtccgtcagaaagtagagcatgaacagccgttggggccccaagggcgggctcagggaccccctaccatgatggaacacacttcatatagtgcctataccccaactgagttgcgggaattaggcaagcagtgtcggcagcgttcgggggaacccctacccgcctggatgcttcacctttgggacgagggagctgacagtattttctgctccacctctgagatggaaaagctggcctccattatgactcacccctccctccgtcagtggttgcaggtgagcaggcagttagcacaggggcaaggcgaccacaccctaattgagtggctgatggcagccatacgaacggtatggaacgatgctggagaaataccagaaactgtgagtaaatggcagtcatatacagatttggtgcaagtaattcaggagatgggtatgcggcaggctatgtttgatctgaatacccgagggccagatgatgaacgctttacctcccacatgagggatcttgtgttgggctctgcgcccccgagtgccttcggctccctggccgctgtcctcaccccgtatgtggggcaccacatacatgaggtgactactgccatggcggccctcagggaagcagaaggccatcggcaggaccggggagtccgcgccataaagaaggggaaggcgccccctccacagggggccaccccatgagacaaaaaggggccccaacgggtgactcgcacgcagatgtggattgatttgattttggctggggttgaccgagagaaaattgataagcagcccaatgaagtactgttaactttgtggaggcaattgtccccagagcagcaattccagaaaatgcccaagagggggaaggacattgctgctcgacccagtcccgcccagacgctccagctcaaggactacttgctgcagccaggcggaggtatagagccttttctgtttgattagggaactggccgaggtgcccggcttggggggacaccggacgaccggaggccacatgtggaattggcaatccactggtcccccaccaatgtacagtgggtgctggcgctggtagataccggcgcagattgcagccttgtctatgggaacccggataagtttccgggcaaggctgcatatattgacggctatggaggccggtcagtgaaagtgaaacctgtatctttgcaccttggcatcggccgcttggctccccgcttatacactgtgtatgtctctcccatacctgaatacattctgggggtggatgttttacatggcttggctttacaaaccatggccggagaattcagactccaagtacgtgtggttaagccggtactgcgtggacatacgcatcaccagccccaggtcctgccacaaccccgacgggttacttccactcatcaataccgcttgccaggtgggcatacggagataactgagactattaagaagttaaaggaggtgcagatagtgcgtggcacccatagcccctacaattttctggtatggccagtcagaaagcctgatggaacttggcgaatgacggtggattatcgagaactaaataaagtaacaccccctttacatgcagctgtaccatctatcatggatttgatggaccgcttgacaacggaattgggacagtaccactatgtggtggacttggccaatgcattcttctcaattgacattgctccagagagccaggaacagtttgccttcacatgggaagggcgacaatggactttcacagtgttgccgcagggctatatgcatagccccaccatatgtcatggtcttgttgccacggatttagccgcctggaaatgtccaaagggggtccacctattccattatattgatgatattatgttaacctctgattctcttgcagatttagaagcggcggcacccctcttgcgacaacatttggcagcatgcggttgggccgtcaacgaatccaaggtccaagggcctggattgtctgccaaattcttgggagttatctggtcgggtaagacgaaggccataccagaggccatcattgataaaattcaggcatatccccggcccaccatggtgaggcagctgcagacttttgtgggcctcttgggatattggcgggcattcgtgccccatttggctcaaatgataaaaccattgtatcagttaacaaaaaagggagctgcctgggattgggatgatgaggctgagaccgcctttctggcagccaagcgggctattcagcaggcacaagccctacgggtagttgaccaggggcgcccatttgaactggatgtgcatgtgaccacagatggttttggctggggcctatggcagcgcacggagcgcttgagaacgccagtaggcttttggtcccaactttggaagggagctgagctccggtattcattgatagagaagcagttagcagctgcatatgctgcccttcaggctcgtgagagcgtggcaggatgggctacagtcatcgtgcggatgacttacccaatagcgggatgggtacgttcatgggtaacgaccccccagactgggacggcgcagacatccactttagcaaagtggggcgcctacttagaacagcggagtacgctgagtacaagtcccttagcagcagagttgcaagaggtcttgggacctgtagtcctaatgcaagataaggccatggggcctgaggcacccctagaccctgagccttcaccgtttaaggaagggcatccccccattcctgatggggcatggtacacagatgggtctagccggggtgctactgctgcctggactgctgtcgcagtccagcctagtactgacaccatatggtttgataccgggtgtggacaaagtagccaatgggctgaactcagggcagtgtggatggtgatcaccaaggaggtgacacctatggtaatctgcaccgatagctgggcagtttatcgaggcttaaccttgtggttaactacctagaagttacagaagtggctagttggtcaccggcccatttggggccaagccatgtggcaagacctatgggaaatgggtcatcaaaaagatgtaactatttatcatgtgtcaggccatatgcctttggccgcccccagcaatgatgaggcagatgccttggccaaggtccaatggttagagtcggcatctacatgagatgtggccttgtggctacaccggaaactgggacatgcggggggtaaactgatgcaacaggtcaataagtgctggggtctgtctttgcccacgcaagacatttgggaggcctgccagaagtgcccagcatgcgctcaggcataccctagacggagacagctgcccagtgttacacaacaagtgacggtagggcggatgcccttgaccagatggcaaatagactacattgggccgctgccaaagtcgcaggggtatacacatgcactgacggctgtagacatggccaccagcctgttgttcgcctacccttgcagggtggccgaccaacaacacaccattcaggccctgcaacacttatgtgccctatatggtcgtcccctggccattgaaagtgataggggaacacatttcactggacagcaggtacaacagtgggcacaacagatggacataaagtgggggtttcatgttccttacaactcgcaagccgcgggtatgattgagtgatataacggactcctgaagaatgggttacacttgcatgttactcccccgtctttgcggggctggagttccaggctggacctggtgctccaaatcttgaatgaatggccacggaaaggcggcccagccccagtggaggcactgttacaccgggccgccgcccctatccagttacagatacacaccaaggatgacctcctccgaccaggtatggggacaaacggtaacctgttgttgcctgccccaacgcccctgaaggcaggggaacagaaaacctggctgtggccatggaccctccaagccccccattgccgatggttggctatcgtagccccctgtggggagggcctacagtatgacttacatgtcactccttgggtatttaatgtatggcctccgcgattgaccgttcataggggaatggccagggaaggaaccctcctccgggggacatatgtactgtctgtgtggcctattatgagctcccctgtgactttggcacggatacaggacccaaaggaaccatggggagctgagaaggtgtggtaccattgcccagggcagaagcccttggtggctgcattgttatccagggatgaaaggttggcctgtattttgcctgagggacgtgatttacccctgttagtacctgtgcctgctttgtcatttcgaccgtaggttgacatgctccaacagcattgtggactgggcccacacctacactgaggtgaccaatgtttccaactgttggatctgcaccgcccttccagcagcagctgcggatggcttgccctggcacatacatccagcttctgcggagaactggacatggctagagacttggggtcccatggccgacggttggaatgcaacacggcaagctttggatagggggtgccgcaaaacccacattgcaatgcctgccccctggctgacccatagcatttatgatggatggggctggctagtgggagaacatgtggtgcccccagcgcaggcaccatgatgtatagagcaacattggggtaatgtcaccgtggggtggttgcccgccacagcctgtgcaaacataacacatgtcaccacaccaaaggtgtggtggaacaagcggcctcaccaaggctgggccccgatggactttgtgccccctgggagtttatgggtctgtggggacacaggatggccatatctgccagcgaattggactggatgttgtacctgggggtggccttatgtgcctgccactgttcttcccacattgcctaggtgcccgcataactgggaggcgctacgttcccggtttttgcgagtgcgacgagccccctggtggttctaccccttagcagtaactatccttggagcgggtgtcatcactgtagaaatgcaagttacagcccttgcagagcacacagctcaggccctgaattacacccgagttgccctccttctgttaacggatgaggttgatcaaatcaggaaggtggtgctgcaaaaccggatggtcttagacatagtaactgctgcccaaggtggcacctgtgcccttttaggaacacaatgttgtacctttatccctgacaatcaccagaacataacagcagctttgcaaggggtgtcacaggagattaaggcggttgagagccttactgatgaccccctgcagagatggtgggcatccctgggctctggcctacgctgggccctaataatcataggtagcatagcgggaatattagtggtgagttgttgctccctgtattgttgctgtggcctatgggtccagggttccaccctatgggcacgtgtccccactaggaggactccctcggcctagggggtgga

SEQ ID NO: 23 - DNA, 4843 bp, Homo sapiens
  repeat_region (1)..(4843): herv23
ttttggtgatgcctatgggacccaaagtggggttccagcaatccctatcacttcactgaaaattgaagccttggtaccgtcatgaatgactttcattgacctgacctcgccaatgtcaacagggatcactgggcaggcccctctcaggatctgcatctttctagcttggctgagaattcagactttatttgagccatacacattcctaacttgacaagtttggaattgaagtctactttaaggcataaattttatttgttattctctggagattgcggagttgtgattttcacttttctctgatgttaaggttttgtgttgaattactcattagagtttttataaccttttctctcattcaaatcttggtcagggagaaaaatagattctctcccttaaaagaggaagtggatatttgtggcttaagcaaaatttataatctttaaaactggccagattctgaaacttgaatcaaatgatgaatctaaactttcttttgactgaccacaattcctcacgctaggtctttttggccattcaaaggaataatctaaattatggtgagtcatacttctataactgggacttctttaagaagagatccagggacgaatccttgatttttaaagatctagatgtgttgccttccagctgtgcctgcttttcacatattaaatattaggccctggccctggaccatgagaacgagctctttcccctattcgttaaaaggctccactctgaagtcagtaaactcataaaaaaacaagctaaattgaaaagaccaactgtctacccaggtaagtctccaaaatatggctttttggcatttagctggctgttttgaaacgctttgtaaaagaaatgtatatctataaattaaatctccatttgtaagggcatctcccttactgtaactaaactgctagaaacatttaagttgaggaacacattgcataacaaactttacctttatttaaggtacttttcctagaatcttggcttgactaggcctttacctatgcctttctttgactcagcaaataatattgtatagatctaagttctgtgcctttgggatgtaaattttcacctaacattcatgtcttcggaggggtgaatttatggtcacctagctaacaattgtttacggcttggtagtctaaagagagaagagaaactctttgaaaactggccaatgaagtaccttataaagctatcaaatcttctgtctgtgtatctgtatgtctacgttgtcaatcaagaataatgacccatatgtttatatgaatcatgtgtatattatatgtaactaccaaattatatgaatctaattaactggcttgaagaaaaagaaaccacataaatcaaatattttattagaaaaacagaaactaactcaaatgccatttagttcacatgacttgggtcatctttcataagtaagacttgtttaatattgctggtttgatgaaaacagttgtgtattctgatcagcaaaatacccatgcatttacctatagagttcttgcttaaatggtaactacctattaataacattcacatactattaaaatgactatcaaaaaaacttgagatgaagactagcttaatttaatgagcaattcaggtataattgttaagaatgaatgaattaaacaaatataaatggaataaatgtttataaataaagtatccattgtttagaaatcattcagtaacttaatattaaagtcatattatgttaaattaagtaatatgtaatcataaagtgtctgagttgcttatatggtatagaaaagagaaacatatttatatttcttaataaaccaaaaaagaaacatttttctaaaaattttgaaatggtttttaactacaaatactcatataaaacagttccaaattacttatttcctagatttttcccagaaaattagggtttataatagttaaaattatagttaatttatatatgtaattaagactagtagatatatgagatacaactcaatatacaaggtatatgaagaaagtcaaatatatttttggtaaaataagatgaaaggagatagtgatatttgtgtgtttgcttggcagaagaaagaactttgtgtggtcaaaatgataagggataaaggaaagtacatttttattctatgatagaatggcaatatttttaaaaaggtataataggataaaattggaggttaaagccagttatataaggtttgtggaagattaagctcatgaaaggaattttgtctgtgattgaattggctaaaattagaagaaaattatttataaggtttttctaaaaattgagcattaatataaaaaacacattaatttaaggccagagtctgggctcctgtgtcagaacaacaattttctcagagcattgatctgttccttaatagaaaattgtaagaggttataaaacatttatggaaatcttatcttatatggtcaaagttgactgagattggatgaatttggtattaaggttttattaaaattagctttagtagtggtaatacagtaatataaaagtaaattttctttttttccctttgaataagattttatgtagtattaatgagagataagatttgtttacctcttgagtaaactacagaaaaaaagggaagagtttatttcatgctgtcattattaggtctcttgattgggaactgggtctcctctctatcaaagagtaaaatttttgctgtttgaaatcttaatctttgaattagtatattggctaaataaatgactgttattttacagtctgtgatcctaatttactatgtgttttaaacctttttaattttaatattaaggtttttaaacctttaatatttgagattcttaaaattacattttaaattctgaagttatctttctgacccaaactgatgaagataattaataaaaactctggaaatccaagagagacatattaaacttctttcatacagaaagaaatgtcaaataagaaattatgtttaagtttcttagagttatatttgtataaatgtgttattaatgtgtgtttcaaaattgaaaaagatgcctaaaattatatcttggaatacattatcagtcataattatgattatgttaaactgttgtattactacaaaaaatagccaattttctgtcaattgcatatttaaccaaaccatgacaattcaaagttttttgtcattcatggacagttattgttttactttgattcttctcaaaaagtagtttatgatcaactgctgtctaaaattggtttcttctgaaaggaaattcatggaagaggatcctgacaagtactcttcagtacaggtttctgataactttagagataataccactgaagtaagtaaaaacttctagaactctaacaaaaactgatgtagtcatgaagattgccaacctaacatcgttaagcagaaaaataattacttacatgggactaagctgatagagaattaaaattatttttatggcatttttgtttgaaccattgttgattctttctaaattttgcttttcagagtcaagaaaacagttttttttagccatttatagcttacagcaattgggtatagtataattttgtgaacaaaactgaaacagttacccttccttctatgtggtttctccaaaatttgaaaactattcatgagcattcttattttatggcaatataatttcataatttcaataaaaagatgctttcttttccaacagaacacattggagacattggtaattttaccaatgttttgtctggaacagtgtattttcagatataaccagtctgctttgagaaattaaagccacatggaaagaatggcctggaacctagtttacacagtttccttacaaggttccagaccttgtagtaaataatgaatatcactttctgacaggctcaggaaactcaagatatttggggactacaagaagagagaaattcactcaatttgtacaggtattgtaagtaccattttatggtgactctttggcttcgcttccttgcctagagataattttaatagtctaatatgaatcttctaatgaaaaatttccagcaaagccaacttaaatttccagcaaagcctgcaggaccagtcactgttcttgtgaatgtttatgcaatgaccaggccaagtataatactaaaacttattttgcaattaaattggtcctactactatttatctttggtagaaatggaaaattggagagagaaaagaatgtgttttagaagaaaactgtagcacacttgttattagattacagccctgactattatttttgagtttttattattttcctacaactcagactaaattctgaagtatttcctggctacaagactctaaagaaaatctgggtgttaatttttttttattatgtttttagttgactcctcaatagaacagttgttttgttgttgttgctctggtacacaatatttttgttataatcctatgtgtgttataattctgctatgtatctcctgttgtttgacttcttttaagaaaactaaacacatgatattctaaagactaaagatgattcaacaagtgatagcaactatgtaaatcagtgacttgactggtcttatttttgtgaacctatgaggccattccaatttgtattttgaagctcttagaattcctcaatgagacatgtcctgtccccccaaccatgtgagatagagccatctgggaatgagctttactagcaatgcaggactaagattctcaacataaaaagagccaaaagcatttgagtttatctatgatgctttcttcaaaagatatttatgaaaaggggggaa

SEQ ID NO: 24 - DNA, 2799 bp, Homo sapiens
  repeat_region (1)..(2799): herv3
ctgggtattcgccctatgaaagactgttcggcaagccatccccaatcataagtcaaattaagggtaatcttcgtgaactaggggaattaactttaaggaggcaaatgcaggctttagggatagccatgtgaagtgtccatggctgggtacaggaaagaatgcccataagcctgatagatccaatacacccctttaaacccagggactctctttgggtcaaaaaataaaacccaaccactctgggacccatatgggatgggctccatactgtaatcttgtctattcccactgttgttaaagttgcaggaattgtgccttggatccatccatccagtcagctgaaaccagcagcccaggacaagtggaccagccaacaggacctagaccatgcaacccagctgatcctacgatggaaccaaggtgccagtgagatgacaacagccctgctctggtcactccggaagctgaccagtccacgcacggctgaagcttgaggagacaacagccctgctctagtcaccccagaagctgactagtctatgcacggccgaagcttgagtcatcatcagggaagtaaatgtggttagaaatctgaagtccagtaattttccttgtcatattaattactttgctattaagctgtcactttgcttagccttctccccccaggaaaaagccttttctgtccatgctgggtatgaacatgctactcatcactttgttcttgctactccccttatccatgttaaaaggagaaccctgggagggatgcctccactgcacccacactacgtgtcggggaacatcatgactaaaaccctgttgtatcacacttattatgagtgtgctgggacctgcctaggaacttgtactcacaaccagacaacctactcagtctgtgacccaggaaggggccagccttatgtgtgttatgaccctaagtcttcacctgggatctggtttgaaattcatgtcgggtcaaaggaaggggatcttctaaaccaaaccaaggtatttccctctggcaaggatgtcgtatccttatactttgatgtttgccagatagtatccatgggctcactctttcccgtaatcttcagttccatggagtactatagtagctgccataaaaataggtatgcacaccctgcttgttccaccgattccccagtaacaacttgctgggactgcacaacgtggtccactaaccaacaatcactagggccaattatgcttaccaaaataccattagaaccagattgtaaaacaagcacttgcaattctgtaaatcttaccatcttagagccagatcagcccatatggacaacaggtttaaagacaccgctaggggcacgagtcagcgatgaagaaattggcccaggagcctatgtctatctatatatcataaagaaaactcggacccgctcaacccaacagttgcgagtttttgagtcattctatgagcatgttaaccagaaattgcctgagccccctcccttggccagtaatttattcgcccaactggctgaaaacatagccagcagcctgcacgttgcttcatgttatgtctgtgggggaatgaacatgggagaccaatggccatgggaagcaagggaactaatgccccaagataatttcacactaaccgcctcttccctcgaacctgcaccatcaagtcagagcatctggttcttaaaaacctccattattggaaaattctgtattgctcgctggggaaaggcctttacagacccagtaggagagttaacttgcctaggacaacaatattacaacgagacactaggaaagactttatggaggggcaaaagcaataattctgaatcaccacacccaagcccattctctcgtttcccatctttaaaccattcttggtaccaacttgaagctccaaatacctggcaggcaccctctggcctctactggatctgtgggccacaagcatatcgacaactgccagctaaatggtcaggggcctgtgtactggggacaattaggccgtccttcttcctaatgcccctaaaacagggagaagccttaggataccccatctatgatgaaactaaaaggaaaagcaaaagaggcataactataggagattggaaggacagtgaatggcctcctgaaagaataattcaatattatggcccagccacctgggcagaagatggaatgtggggataccgcaccccagtttacatgcttaaccgcattataagattgcaggcagtactagaaatcattaccaatgaaactgcaggggccttgaatctgcttgcccagcaagccacaaaaatgagaaatgtcatttatcaaaatagactggccttagactacctcctagcccaggaagagggagtatgcggaaagttcagccttactaactgctgcctggaacttgatgacgaaggaaaggttatcaaagaaataactgctaaaatccaaaagttagctcacatcccagttcagacttggaaaggatagtctccagattcccttttcagaggttggttcttatcccttggaggatttaaaaccttagtacaaatagtcctagccatattgggagtttgccttatactcccttgtctcttacccctcattgtcaaaaatatccaaacagccatagaggctcttgtggacagacggactaccacacgactaatggccctaactaagtattaacccctgccaagaaaagagctacttcctcttgaagtaaatgaagatagtgatgctttctcttaaactttacttataaaaagcatcaaaggggggaat

SEQ ID NO: 25 - DNA, 833 bp, Homo sapiens
  repeat_region (1)..(833): herv49i
gtctgaaaatggctgggaacccgagacacataagattttaagcagcacactttttgttctgaatgtgtcaagctctcaggagggtttgtcttaagaagtcccatccataaggggcttttgtcatctcaacccttgttgcctggttagtcctgggaaagtccaatcccaggagggcctacccggtgtcacggattaatgggtctgtgactggcagccccccacaaatttgtgggttactggaggcaccgtacgcacaaacaccatccttaaccatctgtggcaacaagagtcttttgctatcttagcctattcctgggagtaaattttttgagaatcattgggattgcctcttctatgccctctccaggaacacctcttgcttatatggtaaaagttattctaaacctggaaaattaccttttgggctttccatgaagaggcttattggattgagtcgctattggaataagtacaccattgaaaattctaattgtcaatggccaaaagatggatcctttaaattagaaagactcctaaatttaaaaaaaaaaaggattttagagatctcttattctaaacaattgccttatttgtattgatgggaagatcaaatttaaaaaaagacacataatagtgtcatggctagccttaaaaattctcttgactaaattaaagagcaaaaatctgacctaaaacaaagttaaaatcttttgtacgctcaaactgcccgctttggattccctgcgggattaacaatgaaggccactccatcttgtagtctggtggttaaaattccatactttcaccaccatggcctgggtttgattctcggt

SEQ ID NO: 26 - DNA, 8399 bp, Homo sapiens
  repeat_region (1)..(8399): herv9
ttttggcaaccacgaagggactatcacctatcgccaagcggtgagactattgcatagcgccaagcagtgagtaccatcagacccctttcacttggtattctgtcctatttttccttagaattcaggggctaaatactgggcacctgtcagccagttaatagtgactagcacggccactggactaaaaacacgggtgtcaggctttctgggaaagggctctctaacaacccttgactctttggagttgggagcgttggtttgcctggaaccagcttccacttttcctatacttctaggctgagccaagggtcaacagagaggaaagccatttagctctgggggtcccgaaaacaagttggttgaccctgcagtcatgagcggaactctcaaagtcatgtcacccaagcgagacttgcccatctattctatctaccctgacccttgcctcctgggtcctaatgcctgccagacaaacttcctctcacctctcttctccaaggctagtcctgcttctaaaaaccactccctgtctctggtgcttttctagtttctcctataagaatgatttctagtataaactccaggaatctattcccttctttaggcaactgggctcaccaatcagaaagacataattttttcccaaagccctgtcgcagtggggactatctggaattttaggatccttccttagaatagcaggcctaacgaaagctattcctgaagctaggatatggggagcctcataaattgtatccttcctattcatataaatgaggacaaaaggcatcactcttccaactctggagatcccttccctccctcaggttatggccctcaacttcatttttggggcataacatctttataggacacgggtaaggtcccaatactaacaggagaatgcttaggactctaccaggttttcaagaatatgtcataagggtcaccaaatcctatttttctcggtcctttttgtggtctaggatgacaggcaagggtacaggtttttgagaatgcatcggtaatggccactaaatcctaccttcctcggtcctccttgtggtctaggaggaaatctagtgtttctgatgctgtgtcggtgagcacaactattccaatcagcagggtccagagactgttgccagttcttgggcaggggttgtttctgctgctgcatcggtgattgcaactattctgatcagcagtgtccagggaccattgtgggttcttgggcagggggagaaacaaaacaaaccaaaactatgggcggtttgataggaaacactcaggcatcaacacgctcacccttgaaatgtatcctaagccattgggaccaatttgacccacaaaccctgaaaaagaggcagctcatttttttctgcactacagcctgaccctaatattctctctctgatggggaaaaatggccacctgagggaagtataaattacaatactatcctgcaggttgaccttttctgtaagagggaaggtaaatggagtgaaataccataaggtattacaagctttcttttcactgaaggagaatacacaactatgcaaagcttgcaatttacatcccacaggaggacctttcagcttacccccatatcctagcctccctagagctctccttcctattaatggcaagcctcctccaatctcccctgcccagaaggaaataagcaaagaaatctccaaaggaccacaaaaacccctgggctatcggttatgtccccttcaagctgtagggggtggagaatttggcccaacccaggtacatgtccccttctccctctgtgatttaaagcagatcaaggcagactgggggaagttttcagatgatcctgataggcacatagatgtcctccagggtctagggcaaaccttcgatctcacttggagagatgtcatgctattgttagatcaaaccctggcctttaatgaaaagaatgtggctgtagctgcagcctgagagtttggagatacctggtatcttagtcaagtaaatgatagaatgacagccgaagaaagagataaattccctactggccagcaagccatccccagtatggatccccactgggacctcaactcagatcatggggactggagtcgtaaacatctgttgacctgtgttctggaaggactaaggagaattaggaaaaagcccatgatttattcaatgatgtccaccataaatcagggaaaggaagaaaatccttctgccttcttcaggtggcttcaggagaccttaagaaaatatactccactgtcacctgaatcactcgagggtcaattgattctaaaagataagtttattacccaatcagcagcagatatcagtagaaagctccaaaagcaagccctgggccctgaacaaaatattgaggcattattaaacctggcaaccgtggtgttctataatagggaccaagaggaacaggcccaaaggaaaagagatcagaaaaaggccgcagccttagtcatggccctcagaccaacaaactttggtggttcagagaggacagaaaatggagcaggccaatcagctggtagggcttgttatcagtgtggtttacaaggacactttaaaaaagattgtccagtgagaaacaagctgcccccttatctgtgtctactatgccgaggcaatcactggaaggtgcactgccccagaggacaaagtttctctaggttggaagcccccaacctgatgatccaacaacaggactgagggtgcccagggcaaacgccagctcatgtcatcaccctcactgagccccaggtatgtttaaccattgagggccaggaaaatgacttcctcctggacactggcacgtccttctcagtgctaatctcctttcctggatgactgtcctcaaggtctgttaccatccgaggaatcctggggcagcctgtaaccaggtgtttctcccacctcctcagttgtaattgggagactttgctctttctgtatgcctttcttgttatgcctgaaagtcccacacctttattagggagatatattagccaaagctggagctattatctacatgaatatggggaacaagttacccatttgttgtcccttacttgaggagggaattaaccctgaagtctgggcattggaaggacaatttggaagggcaaaaaatgcccacccagtccaaatcaggctaaaagactccaccacttttccttatcaaaggcaatatcccttaaggcctgaagctcttaaaggattacaggatattgttaaacatttaaaagctcaaggcttagtaaggaaatgcagcagtccctgcaacaccccaattctaggagtacaaaaaccaaatggtcactggagactagtgcaagatcttagactcatcaatgaggcagtaattcctctatatccagttgtacccaacccctataccctgctttctcaaataccagaggaagcagaatggttcatggttctggacctcaaggatgccttcttctgtttcccctgcactctgactcccagtttctgtttgcctttgaggatcccacagaccacacgtcccaacttacatggatggtcttgccacaagggtttagggatagccctcacctgtttggtcaggcactggcccaagatctaggccacttctcaagtccaggcactttggtccttcagtatgtggatgatttacttttggctaccagttcagaagcctcatgccagcaggctactctagatctcttgaactttctacctaatcaagggtacaaggcatctaggtcaaaggtgcagctttgcttacagcaggctaaatatctaggcctaatcttagccagagggaccagggccctcagcaaggaatgaatacagcctatactggcttatccttgccctaagacattaaaacagttgcaggggttccttggaatcaccggcttttgccgactatggatccctggatacagtgagatagtcaggcccctccatactctaatcaaggagacccagagggcaaatacttatctagtagaatggtaaccaggggcagaaacagccttcaaaaccttaaagcaggccctgtacaagttccagctttaagccttcccacaaacttctctttatatgtcacagagagagcagggatagctcttggagtccttactcagactcttgggacaaccccacaaccagtggcatacctaagtaaggaaattgatgtagtagcaaaaggctggcctcactgtttaagggtagttgcagcactggccatcttcatgtcagaggctatcaaaataatacaaggaaagatctcactgtctggactactcatgttgtaaatggcatactaggtgccaaaggaattttatggctatcagactaccacctacttagataccaggcactactccttgagggaccagtgcttcaaatatctacatgtgtggccctcaaccctgccacttttctcccagagaatggggaaccaattgagcatgactgccaacaaattacagtccagacttatgccacccaagatgatctcttagaagtccccttagctaatcctgaccttaacctatataccgatggaagttcatttgcagaaaatgggatatgaagggcaggttgtgacatagttagtgatgtaactgtacctgaaagtaagcctcttcccccagggaccagcacccagttaacagaactagtggcacttacctgagccttagaactgggaaagggaaaaagaataaatgtgtatacagatagcaagtatgcttatctaatccctcatgcccatgctgcaatatggaaagaaagggagttcctaacctccgggggtacccccattaaatgccacaaggagattatggagttattgcatgcactgcaaaagcccaaggaggtggcagtcttacactgccaaagccatcagaaaggtgaaggagaaaaggcagaaggaaaccgtcaggcagatgctgaggccaaaattgctgccaggtggatactcccattagaaatacctatggaaggacccttggaatggaacaaacccctccaagagattaagccccagtattccccaaatgaaacagaatggggactctcatgggggcatagttttctcccctcagggtggttaacgacaaaagaaggaaaggtacttatacccgaagccagccagtggaaaatacttaaaaccctccaccaaacttttcatatgggtattgaaaacactcatcaaatggccacatctctattcacagggccaaatctactctgggccttccaacaggtagtcaaaacctgtgaggtgtgccaaaggaataatcccttggtccattgtaaggcccatttgggggaacaaagaataggtcactatcctggagaggactggcagttagacttcacccatatggcctaaatcaaagggatttcaatacttgttggtctgtgttgatacctttacaaattggatagaagctttcccctgcaagacagagaagactcaggaagtgattgaagtcctaattgatgaaataattcctagatttgggcttccctaaggcttacagagtgacaatggtccagttttaaagccacaataactcagggaatgtccaggctgctagggatacagtatcaccttcactgcgcccggaggccacaatcctcagggaaggtcaagaaggcaaatgaaacactcgaggcacttaaggaaactaacacaaggaacatctcccatggcctactcttttgcccatggccttgttgagaatccgaaattctcctcacaaaatggggctcagtccatatgaaatgctgtatggacaacattttctcacaaatgacctcctacttgatgaggaaaagacaaacttgttcaaagatataacttcttcggcaaaatatcaacaaaaccctaaaaacctacctgaaggatgtcacagagaaaagggaacagagttgtttcaaccaggagatctagtgttggtcaaatctctcccctctacctccccatctatggactctctgtgggaagggtcatactcaataatcctctctacccacactgcagttaaggtggtaggagtgaaatcttggattcaccacacccgagttaaattttggacatcccctgaggaacctgtgagaccatcagctcaggagtcccaagatcagccagaccagcctcaatacacctgtgaaccattggaggacttgcatctcctatttcggaaggaaacatcccagaataaaatggctcctaccactaatcctgaggaaaaaccccttcctccttaaaaaagataagtgaaaacctacataatctttatctttaatacctctccttgcccctttaatggaatccttttactatttcatcatattattaagcagcatactaaccatactctttgtgataggactatatactgtagctcctgccaggatgaaaatcctaatcacatcaaccttctttctatcatccttccttgtgacagcaatttactcctacctttaactcagcctggaaaaaatgatgtcatcttccagagcaccctctttacctttctatttactctttgcctatctatccctcctgcttccttggatacctcatacaatcactgctccccttccactagctcctaattacctctacaagactctcaacttaacccactgtctgttaaaccagtccaatccttccctggcaaatgactgttggctttgtatctctctatcaacctctgcttatgatgccactcccagtcccataaaaaacttggtctttaccaacttaatctaccaccctcattatgaaggaaaagaccttttctgacttctaaatatgcaatcattagctgacttacccatctctgataggaccaagaataccctaacaggaggcgcaatccaacttttacgttcttacatttccaacctcaactattacacaagcaatgaaaagcccatacacagccctgtaactatgaataccatcttaactttccaagcccctttatgcatccaatgcaacctgttatcaggcctgcccctggggcacttactaccccatcagtgtaattaaaccctacaacttcaagccccaactgatcatagtaacttctgagtcacccaaacagctccattcaaatggtttgtctgctcagggcccccaaaaatcatcacctcctccctgcttaacaaacagtccaggttttgtaatggcaaacatattccctgcatgaccattcacccctggacaccctgcagcagcacccccactactagtgaatgccttctcatcccctctttcagtcactctctcaaatggttcctagtagatacaaaatggtttttttctccaatgggaaaatagaacacagggagctcccaatacccctttccagccacttactggagctaccttggcaagtactctaggagtatggataaatgaaaacaacaaattcacacacctttttaatatacacaaccaattctgtctacccagccaaggtatattcttctaatgtggaacatcgacctatatttacctccccactaactggacaggcaactgcaccttagtctttctaagtcccaacattaacattgccctaggaaatcagaccctatcagtacccctcaaagctcaagtctgtcagcacagagccatacaactaatacccctacttatagggttaggaatggctactgctacagggagcagaagagccagtttatctacttcattatcttactaccacacactctcaaaggatttctcagacagtttgcaagaaataatgaaatctatccttactctacaatcccaaatagactctttggcagcagtgaccttccaaaactgcagaggcctagacctcctcactgctgagaaaggaggtctctgcaccttcttaggggaagtgtattgtttttacactaaccagtcagggatagtaagagatgcttcctggcgtttacaggaaaaggcttccgaaatcagacaatgcctttcaaactcttataccaacctctggagttgggcaacattgcctctcccttttctaggtcctgtggcagccatcttgctgttactcgcctttgggccctgtatttttaaccttcttgtcaaatttgtttcctctagaatcaaggccatcaagctacagatggtcttacaaatggaaccccaaatgagttcaactaacaacttctaccaaggacccgtggaccaacctgctggcccttccactggcctaaagagttcccctctttaggacactacaactgcagggccccttctttgcccctatccagcaggaagtagctagagcagtcattggccaaattcccaacagcagttgtggtgtcctgtttaggagggagat

SEQ ID NO: 27 - DNA, 7813 bp, Homo sapiens
  repeat_region (1)..(7813): herve
tttcttggttccctggccaggaagcaaggtaattgaaggacagtcgaggcagccccttaggtggcttaggcctgccctgtggagcatccctgcaggggactctggccagcttgagtgacgcggatcctgagagcgctcccaggtaggcaattaccccggtggaaagcctcgtcagagagtgcgtggcaggcccctgtggaggatcaatgcagtggctgaacactgggaaggaacaggcacttggagtccagacatttgaaacttggtaagactggtcttcggaacttgcccactccatttgagtggaagcgtggcctgatcaaccacggcatgcctgtactggcactttggtttttgtttttgacttgacttgaattgcttgatactttggttttggtttgacctggcttggatttctggatactctgattttggttttgattctggtttggtgaaaactgaaaaagtgtgtgtgtgcactttttacccattctttgttttgtggtgtgcatgtggtgtgagcttggtgttttgtcttgaggaaacatggatcagacacaaaataagcctactcctctaggaactatgttgaaaaattttaagaagggatttaatggagactatggggttactatgacaccagggaaacttagaactttgtgtgaaatagattggccaacattagaagtgggttggccatcagaagggagcctggacgggtcccttgtttctaaggtatggcacaaggtaactagtaagtcaggacactcagaccagtttccatacatagacacttggttacagctggtgctagaccccccacagtggctaagagggcaggcagcagcagtgctagtagcaaagggacagatagtcaaggaaggattctgctccacccgctgagggaaatcaactcctgaagttctgttcgaccaaacatcagaagatccattgcaggagatggcaccagtgatcccagtgttgccctccccttatcagggagagaggctccccacttttgagtccacagtgcttgcgcctctgccagacaaatgtatccctaggccactcagagtagacaagagaggaggtgaagcctcgggagaaacccctcccttggcagctcatttaagacccaaaacagggatacaaatgcccctgagagagcagcagtatactggaatagatgaggatgggcacatggtggagagtcgtgtttttgtgtaccagcccttcacctctgccgaccttctcaactggaaaaacaataccccgtcctatactgaaaagccgcaagctctaattgatttgctccaaactattatccagacccataaccccacttgggctgattgccaccagttgctcatgttcctctttaaaacagatgaaaggtgaagggtgcttcaagcagcaactaagtggctagaggaacatgcactggctgattaccaaaacccccaagagtatgtaaggacacagttaccaggaaccgacccccagtgggacccaaattaaagagaggatatgcaaaggctaaaccgatacaggaaagctctcttagaaggtttaaagaggagagcccagaaggccacaaacattaacaaggtctctgaggtcattcagggaaaagaagaaagtccagcaaaattccacgagagactgtgtgaggcttattgtatgtatactccctttgatcccgatagccctgaaaatcaacgcatgattaacatggctttagttagtcaaagcacagaagacattagaagaaaactgcagaaaaaggctgggtttgcagggatgaacacatcacagttattagaaatagccaaccaggtgtttgtaaacagggatgcagcaagccgtaaggaaaccacatagagaatgaacgtcaggcccggcgaaacgcgcctgttagctgcagcaattagaggggtccccccaaaagaggcaaggcaaaaggggggccctgggaaagaaactcagcctggctgtcagagcttgcagtgtaatcagtgtgcttatcgtaaagaaataggatattggaagaacaaatgccctcagctaaaaggaaaacaaggtgactcggagcaggaggctccagacaaggaggaaggggccctgctcaacctagcagaagggttattggactgagggggactgggctcaaggacctccaaagagcctatggtcaggatgacagttgggggtaaagacattgattttcttgtagataccagtgctgaacattcggtagtaactgcctcagtcgcccccttatccaaaaagactattgacatcatcggagccatgggagtttcagcaaaacaagctttctgcttgccccagacttgtactataggaggacataaagtgattcatcagtttttgtacatgcctgattgtcccttgcccttgttgggaagagacttgcttagcaaactgagagccactatctcttttacagagcacggctctttgctgctaaagttacccggaacaggagtcattatgacccttatgctcccccgagaggaggaatggagacttttcttaactgagccgggccaagagataagaccagctctggctaagcggtggccaagagtgtgggcggaagcgaaccctccagggttggcagtcaaccaagcccccgtgcttatagaagttaagcctggggtccagccggttaggcaaaaacagtacccggtcctcagagaagctcttgaaggtatccaggtccatctcaagtgcctaagaacctttagaattatagttccttgtcagtctccatggaacactcccctcctgcctgttcccaagcctgggaccaaggactacaggccggtacaggatttgcgcttggttaatcaggctacagtgactttacatccaacagtacctaacctgtacacattgctggggttgctgccagctgaggacagctggttcacctgcttggacctgaaagatgctttctttagcatcagattagcccctgagagacagaagctgtttgcctttcagtgggaagatccagagtcaggtgtcactactcaatacacttggacccagcttccccaaaggttcaagaactcccccaccatctttggggaggcgttggctcgagacctccagaagtttcccaccagagacctaggctgcgtgttgctccagtacgttgatgaccttttgctgggacaccccacggcagtcgggtggccaagggaacagatgctctactccggcacctggaggactgtgggtataaggtgtccaagaaaaaaagctcagatctgccgacagcaggtatgttacttgggatttactatccaacagggggagcacagcctaggatcagaaagaaagcaggtcatttgtaatctaccggagcctaagaccagaaggcaggtgagagaattcttaggggctgtgggtttttgcagactgtggatcccaaactttgcagtattagctaagcctttgtatgaggtcacaaaggcgggggaccaggaaccttttgaatggggatcccagcaacagcaagcctttcatgagttaaaggaaagacttatgtcagtcccagccctggggctacctgatctgacaaagccttttacattgtatgtgtcagagagtgaaaagatggcagttggagttttaacccaaactgtggggccctggccgaggccggtgacctacctctctaaacaactagacggggtttctaaaggatggcccccgtgtttgagggccttggcagcaactgccctgctagtacaagaagcagataagctgattcttgggcaaaacctgaacataaaggacccccatgctgtggtgactttaatgaatactagaggacatcattggctaacgaatgctagacttactaagtaccaaagtttgctttgtgaaaatccccatataaccattgaagtttgtaacaccctgaaccccgctaccttgctcccagtattagagatccctgtcgagcatgactgtgtagaagtgttggactcagtttactctgggcatcagtagactgggaactatacgtggatgggagcagctttgtcaacccacaagaagagagatgtgcagggtatgcggtggtaactctggacactgttgctgaagccagatcgtttccccagggcacttcaactcagaaagctgaactcattgctttaattcgggccttagaactcagtgaaggtaagactgtaaacatttacactgactcttgatatgtctttttaacccttcaagtgcatggagcattatgtaaagaaaagggcctattgaactctgggggaaaagacataaaatatcaacaagaaatcttgcaattattagaagcagtatggaaaccccacaaggtggctgttatacattgcggaggacaccagtgagcttccaccttggtgggtttggggaattcctgcactgacttagaggctcaaaaagcagcatctgcccttccgggcatcagtgacagcccccctgctccctcaagcacctgatcttgtacctacttattctaaagaagaaaaggactttctccaggcagagggaggacaagtgatggaggaaggatggatttggttaccagatgggagagtagctgtgccacagctgctaggagctgcagttgtactggctgtgcataaaaccacccatctaggtcaggaatcacttgaaaagttgttaggctggtatttctacatctcgcatttgtcagcccttgccaaaacagtgacgcagcggtgtgttacctgccgacagcataatgcgagacaaggtccagctgttccccctggcatacaagcttatggagcagccccctttgaagatctccaggtggacttcacagagatgccaaagtgtggaggtaacaagtatttactagttcttgtgtgtacctactctgggcaggtggaggcttatccaacacgaactgagaaagctcatgaagtaactcgtgtgcttcttcgagatcttattcctagatttggactgcccttacggattggctcagataatgggctggtgtttgtggctgacttggtacagaagacggcaaaggtattggggatcacatggaaactgcatgctgcctaccagcctcagagttccggaaaggtagagcggatgaatcggactatcaaaaatagtttagggaaagtatgtcaagaaacaggattaaaatggatacaggctcttcctatggtattatttaaaattagatgtaccccttctaaaagaacaggatattccccttatgaaatattatatcataggccccctcctatattgcggggacttccaggcactccccgagagttaggtgaaattgagttacagcgatagctacaggcttcaggaaaaattacacaaacaatctcggcctgggtaaatgagagatgccctgttaacttattctccccagttcaccctttctccccaggtgatctagtgtggatcaaggactgaaacgtagcctgtttgtgtccacggtggaaaggaccccagactgtcatcctgagcactcccaccgctgtgaaggtagagggaatcccaacctggatccaccacagccgtgtaaaacctgcagtgcctgaaacctgggaggcaagaccaagcccagaaaacccctgcagagtgaccccgaagaagacaacaagccctgctccagtcacacccggaagctgactggtccacgcacggccgaagcatgcagaagctcatcatgggattcatttttcttaaattttggacttatacagtaagggcttcaactgatcttactcaaactggggactgttcccagtgtattcatcaggtcaccgaggtaggacagcaaattaaaacaatgtttctgttctatagttattataaatgtataggaacattaaaagaaacttgtttgtataatgctactcagtacaatgtatgtagcccaggaaatgaccgacctgatgtgtgttataacccatctgagcctcctgcaaccaccatttttgaaataagaataagaactggccttttcctaggtgatacaagtaaaataataactagaacagaagaaaaagaaatccccaaacaaataactttaagatttgatgcttgtgcagccattaatagtaaaaagctaggaataggatgtgattctcttaactgggaaaggagctacagaataaaaaataaatatgtttgtcatgagtcaggggtttgtgaaaattgtgcctattggccatgtgttatttgggctacttggaaaaagaacaaaaaggacccggtttatcttcagaagggggaagccaacccctcctgtgctgctggtcactgtaacccactagaactaataattaccaatcccctagatccccattggaaaaagggagaacgtgtaaccctggggattgatgggacagggttaaacccccaagttgccattttaattagaggggaggtccacaagtgctctcccaaaccagtatttcaaaccttttataaggagctgaatctgccagcaccagaatttccaaaaaagacaaaaaatttgtttctccaattagcagaaaatgtagctcattcccttaatgttacttcttgttatgtatgcgggggaaccactatcggagaccgatggccttgggaagcccgagagttggtgcctactgatccagctcctgatataattccagttcagaaaacccaagctagcaacttctgggtcctaaaaacctcaattattggacaatactgtatagctagagaagggaaagactttatcatccctgtaggaaagcttaattgtataggacagaagttgtataacagtacaacaaagacaattacttggtggggcataaaccacactgaaaagaatccatttagtaaattttcaaaattaaaaactgcttgggctcatccagaatctcatcaggactggatggctcccgctggactatactggatatgtgggcacagagcctacattcggttacctaataaataggcaggcagttgtgttattggcactattaagtcgtcctttttcttattacccataaaaacaggtgagaccctaggtttccctgtctatgcctcccgagaaaagagaggcatagttataggaaactggaaagataatgagtggcgccctgaaaggatcatacagtattatgggcctgccacatgggcacaagacggctcatggggataccgaacccccatttacatgctcaatcggatcatacggttgcaggccatcttagaaataattactaatgaaactggcagagctttgactgttttagctcggcaggaaacccaaacgaggaatgctatctatcagaatagactggccttggactacttgctagcagctgaaggaggagtttgtggaaaatttaacttaaccaattactgcctacaaatagatgatcaaggacaggtggttgaaaacatagtcagggacatggcaaaggtggcacatgtgcctgtacaggtttggcacaagtttaatcctgagtctttatttggaaaatggtttccagctataggaggatttaaaaccctcattgtaggtgtattgctagtgataggaacttgcttgctgctcccctgtgtattacccttgctttttcaaatgataaaatattttgttgttactttagttcatcagaaaacttcagcacatgtgtattatacaaatcactatcgctctatctcacaaagagactaaaaaagtgaggacgagagtaagaactcccactaaaagtgaaaattctcaaagggggggaaa

SEQ ID NO: 28 - DNA, 6529 bp, Homo sapiens
  repeat_region (1)..(6529): hervfh21
ttctggtgccgaaacccgggaaggcgatagactctggctgggactcactctctctctctctctctctctctctctctcttcctctccctcccctatcacccctctcccggccaatctcccccttcccgaacctgctaaagacccaaaggatctcctaaattctcccattgttggcgacctcatccaccatcaaagcctccaccagggtgagtgaaaagagactgttgccgttccccagaacccttgaccatccatctctccacttccaaaagacccagcgctgggccaagggcttcctcccgtctctgggcctccaggaggccctcgattcctccatttcagggatgcctgactcggcggttacctcctttattccggacaagttccgtgggaaaggggacgccctctcccaccgtccttgtcatcagcagtctcttcttcccctaccctcccctcctccattcactataggagcctcccaatccactccttccaagaccaccccgctgggtgcctcctccgcaatctcaatgctctcggcctccattcagaaatccgttctaagaggcttatctttttcaacgttctcagatacagacaacttttgccatcgaaatgggaaatggtctgagattccttatgttcaggctttcttcactctccgtaaccgcccttccctctgtcagtcctgttctactttccaaatcctcctcgcccgctccaaacctgactcgcctcctacccccctccccacagccccagctgacgattcctcttcctttgaccctgccaattttccccttccccgaaagcatcacgatcctccaccagagcatcctgatcctccaccgtatgtccccactccagctctacctttctcccctcctctctccaaccaccctgcttctgactctgggtcctctctctctccacccctcaccccctctttggcccaagatgctcagcaaccagctcccttgcttcctcttcaggaagcagcaggagtcgagaggatcgtccgtgtccacgttcccttctccctctctgatctctcccaaattaagaaacgtctcaggtccttttcctccgatcctgacacttatatcaaaaagtttaaataccttacccaatcttacgaactcacttggcatgatctctacattatcctctcttataccctcctcccagaagagaagaaaagatgtggctcgcagctcaggcacatgctgatgatcttcatcggcaagatcctactaagcccgtagaggccgctgcagttacctgggaaaagccttcccgggagtaccaacccacaaaccccagccgagcatctcataaccacatgattacttgcctcattgcaggccttaacaaagctgcccataaggctgtaaactttgaaaadcttaaagaaatctcccaaaggcchgacgaaaatcccgcccaatttcttttccgccttacagaggccttccaaaaatatacccacgttgaccccgcctcccaggaaggaactattgttcttaacactcagtttatctcccaatccactcccaatatttggcgcaagcttcagaagcttgacgacagccctcaaaccccacaacgagaccttcttaatttagccttcaaagtctttaacaatcgtgatgaggaaagaaaggcaaaaacaggcagagtttcaaacgcttgcctttgccatcaggggccctgcaggccacgggacgcagctccacatggaagcctcctagcaattcacttccacctggcgcctgtttcaagtgcggcaatgaaggccactggtccagacaatgccctaacccagataagcccaccaggccgtgcccctctgcggaggacgccactggaagtcagactgtgagtggcccccgcaaggactgcccccatcccttcctgagccggccaaaacctcctactcagatctcatcggccttgccactgaagactgacggtgccctggaacggacgccccggcaactaccatctcttcatccgagccaagggtaaccctgatggtggcaggtaggccagtatattthtttttttcaatactgggacaacctactctgctttacctaatttttcaggacccaccgagtcctcccaggtctctgttgtaggaattgatggacaagtctccaaaccccgagccacccctccactcttctgttccctgcacaatttttccttcactcactctttcttagtcctgccctcatgtccaactccactcctaggcagagacatcctttcaaaattccacactactcatgtcttcctgtccaccgcaaccagagtccctcctgctcctctctgctagtccggcccctgacccctctccccagcacccgctacccacctctctcgttaacccagtagtgtgggacaccaccaccccttccatagctgctcaccaggaccccatcaaaatccagttaaaagacccctctaaatttcccaacattccccaataccccatttccctaacacaccaaaaaggcttacaacccatcataaacaagctctgctcacgccgtcttcttagaccaacacgttctccatataacacctccatcctccccgttaaaaaatctgacggctcataccaactcgttcaggacctccgagccatcaatcaggctgtcctccctattcatcccgtagtccctaacccctatacacttctctctctcatcccctccaacaccacccactacaccgcaattgacctaaaagatgctttctttaccattcccctacaccccgattcccaaaacctctttgctttcacccggaccgaccccgacaccctccagtcacaacaactcacgtggactgtcctccctcaaggcttccaggatagccttcttttcttcgggcaagccctagcccaagaccttgcctccttggatctttcccccagccgccttcttcaatatctagatgacctccttctctgtagcccctccctaaaaaactcccaaactcacactgccacccttctgaatttccttactaataaaggctatagggtctcccctctaaagaacagctttccacctccatggtgacctacttaggaattcaactttcccctggggcccgggctatgaccccagcccgagcggccttaatagataaataatctaccccgccctcttccaaaagcgaaatcctttccttcctagggctagcaggcttctttagaatatggattcccaactttgccctcctagctcaccccctctataaagcggccaaaggccctctcaatgaacccctaaacycctcacataacatactccccagcttccgcgaactccaaaccgctcttgtcactgcaccagctctgtccttacctaatatctcccaacctttcactctctatactgccaaaaaccgaggaatagccctcggtgtcttaggacaacagaaagaaaatcctccttcctttgcccctgtagcctacctctctaaacaactagacaacacagtcaaagggtggccaacctgtcttaaagtactagcagcggcagccagttttagctctagaaagcaggaaactaacattcagccaaaataccaccgtctacagtcctcataatctacaagatctcctctcctcccgagcattaagctcccttcctccttcccggattcaattactccatgccctctttatcaaaaatcccaaattcagtcttgccaaaagtgctcccctcaacccagcatccttactccccgtatcctcttcccttcctactcattcttgcactgacatcctagaccacctgcagccacactttccaaacatttcctccgagcctctcaccaaccccaatgatcaactattcatagatggctcctcttccgggcccactggctcccccaaaattgctggatatgcagttgtttcccttgaccaagtaattgaagctaagcccctacctccaggaacctcctcccaaaaagcagaactcataggctctcaccagagccctaaccctttccaaaggcaaacgagtcaacatttatacagactccaaatatgcctatcacattcttcattcccacgccgccatctggcaaaagagaggattccttactgccaaaggaacccccatcactaacggctccccttatttaccaactccttcaggctgcacacctcccaactaaagcaggagttatacactgttgaggacatcaaacaggttcagaaaggcctttgagggaacagattaatctcaagaggrarcasraargcyrayaaggcagcaragaacagaatctcaggagggatcagaaatgaaatctcaagagggaacagaaaggccgatgaggcagcaaaagaagcctccctttcttctgcccctgcctctctcctcctcattacccctgcaatccaacccaagwactctcccactaagaaaaggcttcactactacaacaaggaacctccttccaaggggactggatagtcaaaaatcaaaagctcgtcctcccccaagagcaaaccaaagaaattctgacatctcttcaccaatccttccatatcggtgcgcgccccctgtacctactcctttgcccttatttctcctcyccccayctattcacctcactaaaagacataacctcaaactgtcatatatgctctgttacttcctcccaaggggccctccrctctccatctattcctacacatcagctaagaggaacactcccaggggaggactggcaaatagacttcacccacatgcctcccgtcaagagaacaaaatttcttcttactcttatagacaccttctctgggtgggtagaagcatttcctacctcttcagaaaaggccgcagaagtctcccaaattcttgtaacagaaatcatccctagatttggtctccctggctccatacaatcagacaatggcccctagcttcatctcccaaatcactcaacaggtttctcagtcccttggcatccagtggcgtctccatatcccatgctggccccagacatccggaaaagtcgaaagggcaaatgggatccttaaggctcagttaaccaaactcactcttgaagtccaaaaaccatggacctcccttttgcccatagcactggagagcattagagccagtccaaaagcaccctccttcctcagtccatttgagttaatatacggacgccctttcctcttacaaaacaggcccccttctaactctcagctaggagaatacctcccaacagtctccctcatgagctatctcctctgccaacaagccgaccagggccctcccaaaaccccacgaaggcccttgacacctcccacctccttaacaaaaattcagggtactgtaatggccgacacctcccctatttatccctcttctcttggctcccctctccatacaccatccttaccctatacccaccacccgggacggtctccttctcccaacatccaacaacactcccacatgcatcttagtggacagaaaacgcttcctcttacactgggaaaaaaaaaaaagaacacaaaaagcctcccagcttaaaccaaacaccctttaacaaccacttctgacagcagccctagctgggaccctaagagtatggatgattgagaataacaaaatagtacatctttttagcatacacaaccagttccgtctaccaagccaaggcatacttttcctatgtgatacctcaacttatattgccctcccctctaactggcgaggcacctcagcaccctgcttttcctcagtccaaaaatcactgttgccccaggagaccagcccctactaatcccagttaatatccctatctgacacgacsatactatacaactcatacctctgttagtaaccctcagaataactacaggagttggaactgggattgtgggattaaccacctccgtttcctattaccaatccctctccaaagacttcacgaatagcttggaagagatagccaaatccattacaactctccaatcacaaataaattcttagcagcagtagttcttcaaaaccgcagaggcttagacctgttcacagcgaaaaaaggagaactctgcctttttctagatgaacagtattgcttttatcttaaccaatctggcgtgatacaggatactgtaaaaagactaaaggaccgagcacaaaaaattaaagaaaacgtcctctgatggccagcgtggccctcctggtcttttagtacctggtttccatggctactgcccctcctaggccctgccgtaaccatttttctctttctagcatttggcccttgtctcttacatctccttacccagtttttacagggccgtgtcagagccttcacccacggaacagtacaagacatgatgctactccaagaataccgacggctccaggaacagcagtccctactgtccagccttcccccccaaccatcgccccttcccagcaagaagcagccagaggacaacggcgcccctcttctattacctattaaaaggctggaa

SEQ ID NO: 29 - DNA, 6996 bp, Homo sapiens
  repeat_region (1)..(6996): hervg25
  misc_feature (1202)..(1202): n is a, c, g or t
  misc_feature (2310)..(2310): n is a, c, g or t
  misc_feature (6848)..(6848): n is a, c, g or t
  misc_feature (6902)..(6902): n is a, c, g or t
tattttggtgcattggccgggaaagaaaggrattcatcggaagggtgagtaggagtggacatttaattctttactttcattttggagkcttgtcctcagtttttttttttttcttctcaagaahcaaacaaaacactgggccyctgtyrgccagttaaaagctdttagdgcggctdccagccttaagactcaggggacaggcttgctggagaggahtttgtcaatcccccatcgcccthaggtgttgggaatgttggctctgttctaatccagtttcctttcacggagggcctagccgtcgcatggggctggaaggaggtcctggggcaactgaaggtttctggttgaggctacacctcagtgttacctgaaggcccctggactaactccagtccccgacagcccatgcagggtgtcggcaccaggacttccagtcttttctattkcattttcttcctttcttttctcgactatcatgtctcctatcccttctttgtatgcaatgttgtgggtgtttttacagcctggggatataatcttgttgagtaaagtcagtcagtgccttagtaatcagaaatgtaactcarwgaattgttgtytttgtgatttccttgaahtgaadaaattchaaatcctbdatctgtagacctwtttctcycccagtrataaacattcatggcactgtatgagrgratatttcaccctgagyaaatayccycctttgcatttaahhtsttttttttcctycatgtgaaarsycagcaytgtccaatgaatctaaacagycyytctatgagacaagttawtttttttstwctgggrcayatrctatrggracagcctatcaarccccaaacstctctttctaacttttgcctgaaaarwatwwagtyrgagtttttacctarcatttcagaccttacaggaccacctagtggratggggttkttctccatrggragccytgtcaaccctttgccccaaacctactgtytcccaattcttttctcttttaagtccctctgtcagtgatcagtccccatrccccatttywagccaagaaaattcaactttcaatagcccggaggaagccatcctgacaagacagattttagccywkakwctatctccatsraaggaargacagctattcaattcttacgttatccttraggcacctgttcttcatcmaactacattgnratttaaacaaaaaaaggattttatatttgaaagtcaactggtcccactctctgggattctratgtttccctggggccatagcaagggaagccaaagatagtgtttaggcactccctccattaaagtctgttgccyaaatccaactacgacataatctctccccggtccctggggtaccttgggagccttttgggctgagtgggtctaggaaaccagcagaatggaaaactaggacctkagacagatgagcacataactwgtcctgccacctacgtcctccagatctatgggtgaagatcatacttgcatccaygggtgaaacctatggtggttaccgagacccagaggwcaaggaagtgaagaggagaagggagatgccctttctctctttctctccaccctaggtcactcagaagggaaaraggagactaagggatgcctttgtctctcctctttttctagataggtaacaaaccatctacagtctacactcctctcaagtgcattctgaaacactggaactcctttgaccctgagactytgaagaaaaagcaacttatattctattrcacaagggcgtggycatcttaccarctrcargacagacgggaggcctggccttctcaggaaagtgttaattctaacactatycaacaactagatsttttctrcagayrggaggrcaaatggtccraggttccctatatacaadctttctttgccctgygagacaacccaratctttrtaagcattgtaaaattaaccctgccctcttgacagccatatcagacaatactacaaaagataattccccaaagtcagagacaaakacaacttctaggtgcctttcctgcyccccttatttgaggcccccatagccatatcatcagctcctccagttttgctacccaagaaacccctacattcactgttacctctacragaaatgcccatcagacakagkactactakggttcaagttcccttctcatcacaggaccttagacaaataaagggrgacctagcaaagttctctgakaaccctgatagatatatraaggctttccaaaatctamyacaagtgtttaatcttacatggagraakngtakackacttctaagccaaaccctaactactamcaagaaacagacraccctacagacaacaagaacattcagagatgaacattcctcctatgaccagtcraaaagagaacccagtcaaarttaaagaggwgaaaaagagacaagatcccaattcccaataggawgagaaacagtgcccctwgataatcctaatgagagccctagtgatcycatagatgratgagtagaaaagaaaaacactttckatgagacatattgaaagactkacaagaacacmgawccagacatcttaattactctaaacygtctatgttaaacaraaatccagataaaaatccctcagcctttatggaagggctgagaaaagctttrataaaacacacctccctkcctatcaattcagtaaagaacagatttattactcrracagcccctaatatcrtaragaagttrcagaaacagaccctgtccaaaaatctctctgrtttttctcaycctcaagttaaaactttacagtatataaatarcrctctcctctgtgccccaactraagatgtctcarrraagrcactgarrctctycttaatttcttarctgaaagrrcatatagggtctcaaaatctaargytcarctctatcaaacttcagtaaaatrcctaggtctagtcttatcagaagggacmagaacaccaggtgagraaaraattaagcccatttcctcytttccctttcccaaaactcttaaacarttgaggggattcttagacattactggattttrcaaattatgggtatstgggwatggtraaatagctaaycytttataccaccttataaaaaaaamctcaagcacctaaaactcactysctaacttgggaacctaaaactmaaaagccyttaaccaaytaaarcaagccttacttaaagcaccarccctcagtcttcccatarggaaggcatttaatctytatgtatcaaaaaggaagtkaatgaccctgggagttttaactaaggctcaaggtccagctcaacaaccagtgggttacctaagcaagaaacttgacttgatggctaraggatggccagcytgcctctgagcagttwyrgtggtggctctgctggtaccaraggccacsaagttaacmmtggggaataactgtytrcayyccacacaaataayaggactgctgtcctctaawggaadtctctggctaacaatcacctcctcaaatatcaaactttgytrctarrrkratctrcagtccrrttraaaacctgcccttgcctraacccagycactttctcccagargaaactaragarcctraacakrattgtraacagstartggtryaaactggtaaaagaaataagaagaatcactgtttatattctctgtaaagttttaattaattaaataaacatttttaaagtgtactcaacttaatgaaaagtgaatatccaagctataagtatattcaaaaagcctttctatttttatctttataaaacttgttttcctggaagaggdttttttctcacttaactgaattacttttatccactctttcttgtcactgttgatgcaagcatagaaggccctaaaataacctctggtggcctaagactcctcaagaaaacaaaaaagccaccacaaattvcattttrraaaaaatctctgctttttttcatrgaaaccctagaattaraaabaaataagtccctctcaaaatcwgcttttktcttctagctatgcttrtttrttaggccctggaaactatattcctagccctgttcttaaaaggcctcaaccagagaccaataatccaattagaaaaytggcaaacaaaaaatcttatagttactgaatyttcttctgtttgtbtagatggttatatacgtgwtktgtgtgatgtctataaaaaacctctaattaattggtgtacaaataagcacttrratcaaahattatttmaaaasaawataaaggctgtagtgcctcttggttcatgtaactttaatatttaavaaataaaaacattcttgtaaaatacaaacgtcttmaaaatgtaaataggtggtctaaattatgcaggtcaaatactaggtttgctaaatgttttaakgttgtaaactgcttctttggcctttaagtactgtcaacctgccagcttcacaattagtaaggcctggtgacatatdaaagtaaccatgcccctaactatactggaagaagtcagactttatctrmwyctagcacataattaaaacaacttaccaggttttacattaaagttaaaattacaaaaagttaccattataacatgtaattgagactactgaaaatggatttgcatgcaabgtgtgtaaaadcagtaaaattttttaataaaaaattataagaaggcataaaaatctacatttttcctaggagtaaaagattgtcttaaattaaataaagtgaaagttttaagcaaatttttgaaatactrtaaaaattaatytttwtttaamctaaattcaaaggaatatcatatggtgttcctttaaattaagcattkaaatgaaagcacaacaaarywytcttaaaatgctaatctrctctdtatcaaaatttctaaaagattataaaagatttgtaaamatcaaactggttaagattaaatararttatcyataarrkttcattaaaattgggrttaacattaatartaractartrcaargrkaaaatttrrctttytctyttwaacagrattttyaygtartartwargrcyaataaaagatwtttgctttttcaaatwtttraktcatkttrrcaaaayaartarcttatrrtaatctaaaaktctattyywtaakatyaamtgttttaramctctaacatattyaasaarskycccaaaatyaaacttcagtytcaagrttrtctttcctrayscmtrrcttttagrgcmcctararcatcaaaagaaagryaaacaarwtattkaayatrtttarrtasrtgggattgymaaaatgatrtyttyttyttcagwttatatttmrrtawataayattrayatatgttccaaaaytrtatrrrrtgtctaagrttctartgtmtamatatrtgctaycaatyawaattaaggttrttatrttrsrwtattrtaaamtcararataaccaaatttytttgtcartcgtgtcaracaattktcttgtttkaatcctcttaaaaatgrtttataatcarctrtrrgactttaayarrtrctmtcaaatrcagrtttctrataacagawaaamrtacrgaactcataaaaarctaaaatrtttayrratatcaarcagaacaaagttaayaraatrraytkarctaatrraaaactraarsaatgyttttaacttttrcttattaaaasttttaacmactragcaarryatactscttaaacawaatttrgamcwtrtytrtttctytttgcctggttcykctaraawtmaraaactadttataaatattyttaacttryarcaatatasytrtttrcatcadtdvaamaaaatccattttcttatgcaatgaaacacaatagaaaaaygctagttcttttacaagrctttaactggaagggtgtgttttcctttaagaaatcaagtttaagttgcaaagccagtaacagcctcttgggaaagctggtctcataccttgtctacacagtcctcatacagaattcctggcctgtggtgagtaaaaaaatgtcactttctaacagactcagaaacactatghtcttgggacctcaaaaatacaggagtttacccaactcacaaatatttaagggtacaaatccatggcttggcccaactttadaaagtcttatctaagatttcttttggaacagadttccatcaaagccttatbaaaaaggcctatggagagatagttactcttgctgcactatgttcaaatartyaggccaagtataataataaagtctattttgcaaacaattcartctatyrtgakttrtttttaacaaaaagaaaactaaaagaaagaaatyatgtttcaaadcttatcatacatttgtcattaaattctaatagttatkttttaagtttttghbtacattttaaactaaccctacttattcctgtgaaccaaccavhgatctcbvactvtaacttaaaaaaacaaaaaggaadggataatataaaaactaaaawmcgtctaattctagacaagtatcctacaaatcckaysrradaatgaaaataaataggatgcccataacccagaggtttatttatttagaaaadcaagaccaaagaaactaacaaagccchaatacacccaaatcttaacagacataattatavtcaccaattatcaggdbatatcaacagcctcaacatttttagdcttgtccttacccccgttgtctcattttaatacatgtcctctaataacccaaattrtttcttttyayctaaaaactatcaaactccaaatgrtaatrcaartgraatgatgcataaacacncctttcytctragracccttaaaccagcctcrrgaraartcctaactgctgttncctacacracacccctytccagcargaagtagccaaaawaatyawcgcycaatctccctaacarcagttggrgtctccactyctgagggaggac

SEQ ID NO: 30 - DNA, 7713 bp, Homo sapiens
  repeat_region (1)..(7713): hervh
tttggtgccttgactcggattgggggacctcccttgggagatcaatcccctgtcctcctgctctttgctccgtgaaaaggatccacctatgacctctagtcctcagacccaccagcccaaggaacatctcaccaatttcaaatctggtaagcggcctctttttactctcttctccaacctccctcactatcctttaacctctttctcctttcaatcttggcgccacacttcaatctctcccttctcttaatttcaattcctttcattttctggtagagacaaaggagacacatcttatccatggaccccaaactccggcgccagtcactgattagggaagcagcctttccttggtgtttaatcattgcagggatgcctctctgattattcacccaggtttcagaggtgtcagaccacgcagggacatctgccttggtccttcacccttagcggcaagtcccgcttttctgggagaggggcaagtaccccaaccccttctctccatgtctctaccccttctctgcttttctggggcaggggcaagaacccttcaaccccttctccttcacccttagcatcaagtcccgcttttctaggggggcaagaacctccaatcccttatttgcatgccctgacctcttatctctgcaccctaatcccttatttccgtgccccaacctcttatctctgcaccccaatcccttatttctgtgccccaacctcttatctctgcaccccaaccccttatttctgtgccccgacctctttcccgcttttctggagggtaagaacccccaaaacccctccctctgtgtctctactctctcttttctctgggcttgcttccttcactatggacaactttccaccctccattcctccttctcccttagcctgtgttctcaaaaacttaaaacctcttcaactcacacctgacctaaaacctaaatgccttattttcttctgcaatgctgcttaaccccaatacaaactcgacagtagttccaaagagccagaaaatgggactttcaatttttccatcctgcaagatctaaataattcttgtcgtaaaataggcaaatggtctgaggtgtctgacatccaggcattcgtttacatatcactcccttcctagtctctgtgcccaatgcaactcatcccaaatcttccttctttccctcccacctgccctctgagtcccaaccccaagcattgctgagtctttctaatcttccttttctacagacccatctgacctctcccctcctcaccaggctgagctaggtcccaattcttcctcagcctccactcctccaccctataatccttttatcacctcccctcctcacactcagtctggcttacagtttcattccgtgactagccctcccccacctgcccagcaatttcctcttaaaaagttggctggagctaaagacatagtcaaggttaatgctcctttttctttatctgacctctcccaaatcagttagcatttagactctttttcatcaaatacaaaaaacccagcccagttcatggctcattcggcagcaaccctgagacgctttacagccttagaccctaaaaggtcaaaaggccgtcttatcctcaatatacattttattacccaatctgctccaaacattaaataaaactccaaaaattaaattctggccctcaaaccccacaacaggatttaattaacctcaccttcaaggtgtacaataatagaaaaaagttgcaattccttgcctccactgtgagacaaaccccagacacatctccagcacacaagaacttcgaaatgcctcaacctcaggtgccaggggttcctccagaaccttctcccccaggagcttgctacaagtgccagaaatctggccactgggccaaggaatgcccacagaccaggattcctcctaagctgtatcccatctctgtgggaccccactaaaaatcagactgttcaactcacctggcagccacttccagagcccctggaactctagcccaaggctctctgactgaccccttctgagatcttcttggcttagcagctgaagactgacactgccagatcgcctcggaagcctacaggaccatcacagatgctccaggtaactctcacagtagagggtaagtctgtccccttcttaatcaatatggaggctacccactgcacattaccttcttttcaagggcctgtttcctttgcctccataactgttgtgggtattgacggccaggcttctaaacctcttaaaactccccaactctagtaccaacttagacaatactcttttaagcactcctttttagttatccccacttgcccagttcccttatgaggccgagacacttcaactaaattatctgcttccctgactattcctggactacagctacatctcattgctgcccttcttcccaatccaaagcctcctttgcatcttcttgtatcccccaaccttaacccacaagtataagatacctctattccctccttggtgaccaatcatgcaccccttaccatctcattaaaacctaatcactcttacccggctcaatgccaagatcccatcccacagcatgctttaaaaggattaaaacctgttatcactcgcctgctagagcatggccttttaaagcctataaactctccttacaattcccccattttacctgtcctagaaccagacaagccttacaggttcaggatctgtgtcttatcaatgaaattgttttccctatccaccctgtggtgctgaacccatatactctcctatcctcaatacctccctctacaacccattattctgttctagatctcaaacatgctttctttactatccctttacacccttcaacccagcctctcttcgttttcacctggactgaccctgacacccatcagtcccagcagcttacctgggctgtaatgctgcaaggtttcaggggcagcccttattatttcagccaagctctttctcatgatttactttctttccacccctccacttctcaccttattcaatatattggtgatgttcttctttgtagcccctcctttgaatcttctcaacaagacacacttctgctccttcagcatttattctccaaaggatatccccctccaaagctcaaatgtcttctccatccgttacctaccttggcataattcttcataaaaacacacgtgccctccctgctgatagtgtctgactgatctctcaaaccccaaccccttctacaaaacaacaactcttttccatcctaggcatggttggatactttcgtgttaggatacctggttttgccatcctaacaaaaccattatataaactcacaaaaggaaacctagttgaccccatagatcctaaatcgtttccccactcctctttccattccttgaagacagctttagagactgtctccactctagctctccctgactcatcccaacacttttcattacacacagctgaagtgcagggctgtgcagtcagaattcttacacaaggaccgggatcgcatcctgtagcctttttgtccaaacaacttgaccttactgttttaggctggccatcatgtctccatgcagcgtctgctgccaccctaatacttttagaggccctcaaaatcacaaactatgctcaactcattctctacagctctcataatttccaaaatctattttcttcctcacacctgacacatatactttctgctccccggctccttcagatatactcactccatttattctcccacaattaccattattcctggcctggacttcaatccggcctcccacattattctggataccatacctgaccctcatgactgcatctctctgatccacctgacgttcaccccatttccccacatttccttctgccctgtttctcaccctgatcacacttggtttattgatggcagttccaccaggcctaatcgccactcaccagcaaaggcaggatatgctatgaactagttgccttaattcaagccctcactcttgcaaaaggactacgtgtcaatatctatactgattctaaatatgcctttcatattctgcaccaccatgcggtcatatgggctgaaagaggtttcctcactacacaagtgtcctccatcattaatgcctctttaagaaaactctgctcaaggctgctttacttccaaaggaagctggggtcattcactgcaaggggcatcaaaagacttcagatcccattgctctaggcaatgcttatgctgataaggtggctagacaagcagctagctctccaacttttgtccctcatggccagtttttctccttcacatccgtcactcccacctactccacagctgaaacttccacctatcaagctcttcccccgcaaggtaaatggttcttagaccaaggaaaatatctccttccagcctcacaggcccattctattctgtcgtcatttcataaccttttccatgtaggttacaagccactagcctgtctcttaggacctctcatttcctttccatcatggaaatctatcctcaaggagatcacttctcagtgttccatctgctattctgctacccctcagggattgttcaggcctcctccctttcctacacataaagctcggggatttgcccctgcccaggactggcaaattgactttactcacatgcctcgggtcagaaaactaaaatatctcttagtctgggtagacactttcactgggtgggtagaggcctttcccatagagtctgagaaggccaccgcggtcatttcttcccttctgtcagacataattccttggtttggccttcccttctctatacagtctgataacggaccagcctttactagttaaatcacccaagcagtttctcaggctcttggtattcagtggaaccttcatatcccttaacatcctcaatcttcaggaaaggtaaaaccgactaatggtcttttaaagacacacctcaccaagctcagcctccaacttaaaaaggattggacagtacttttacctctcgcccttctcagaattagaacctgtcctcgagatgctacagggtacagtccatttgaacttttatatggacgcactttcttgcttggtcccaacctcatcccagacaccagccctctaggcgactatcttccagtcctccaacaggctaggcaggaaagtcaccaggctgctaatcttctcttgcctactccagatccccagccatatgaagacactctagctggacgatcagttcttgttaagaatctgacccctcaaactctacaacctcgatggactggaccctacttagtcatctatagtaccctgactgccgtccgcctgcaggatcctccccactgggttcaccattccagaataaagctgtgtccattggacagccagcctaatccctcctcttcctcctggaagtcgcaattactctcccctacttcccttaaactcactcgtatttctgaagaacagtaataacccttatgagcctaatacatcccttcattctattaggtctgtttgtccttaccctactttttgcaacagggctttatgaactcacccccaccacttaggctgagcccaaaaaatcttgtcatccctactattttctgtccagtcatactcctattctctgctctcaactacttataaatgccgtactcttgtttacactgctggtttacactgtttcttcaagccatcacagctgatatctcttggtgctatccccaaaccgccactcttaattccctcttagagtgggtagatgatctttgctggcagggcaccctccaatacttccaccctgatgaagttctattctttacttttatactctctcttattctcattcccattcttatgccaccttttgcctctccccagctatctccaccacactatcaaccttacccattctctcctagctgcttctaatccctccttagtgaacaactgctggctttgcatttccctttcttccagtgcctacatagctgtccctgccttacagacagactgggctacatctcctgtctccttacacctctgaacttcctttaacagccctcacctttaccctcctaaggaactcatttactttctagacaggtccagcaagactttcccagacatttcacatcagcaagctgccgccctcctccgcacttatttaaaaaacctttctccttatattaactctactccccccatatttggacctctcacaacacaaactattattcctgttgctgctcctttatgtatctcttggcaaagacccactggaattcccctaggtaatatttcaccttcttgatgttcctttactctttatctccaaagcccaactacacacatcactgaaacaattggagccttccagctccatattacagacaagccctctgtcaatactgacaaactcaaaaacattagcagtaattgttgcttaggaagacacttaccctgtatttcactccatccttggctaccttccccttgctcatcagactctcctcccaggccctcttcttgtttacttatacccagcccccaaaataacagtgaaaggttgctcatagataatcaacgttttctcgtacatcatgaaaattgaacatcctcctctatgcagttaccccatcagtccccattacaacctctgacagctgccgccctagctggatccctaggagtctgggtacaagacacccctttcagcactccttttcacttttttactttacatctccagttttgcctcacacaaggtctcttcttcctctgtggatcctctacctacatgtgtctacctgctaattggacaggcacatgcacactagttttccttacccccaaaattcaatttgccagtgggactgaagagctccctgttcccctcatgacactgacatgacaaaaaagggttattccactaattaccttgatggttggtttaggactttctgcctccactgttgctctcggtactggaatagcagtcatttcaacctctgtcacgaccttccgtagcctgtctaatgacttctctgctagcatcacagatgtgccacaaactttatcagtcctccaggctaaagttgactctttagctgcagttgtcctccaaaaccgctgaggccttgacttactcactgctgaaaaaggaggactgtgtatattcttaaatgaagactgttgtttttacctaaaacaacctggcctggtgtatgacaacataaaaaaactcaaggaaagagaccaaaaacttgccaaccaagcaagtaattatgctgaatccccttgggcactctctaattgcatgtcctgggtcctcccaattcttagtcctttaatacccatttttctccttcttttattcggaccttgtatcttccatttagtttctcaattcatccaaaactgtatccaggccatcaccaatcattttatacgacaaatgtttcttctaacaaccccacaatatcaccccttaccacaagatctcccttcagcttaatctctcccactctaggttcccatgccacccctaataccgcttgaagcagccctgagaaacatcacccattctctctctccataccaccccccaaaaattttcactgccccaacacttcaacactattttatttttcttattaatataagaaggcaggaa

SEQ ID NO: 31 - DNA, 5120 bp, Homo sapiens
  repeat_region (1)..(5120): hervh48i
tattttggtgctgaaatctgggaggggctcaggtctgcatcccccatggacctagccctccaccccaaagagcaggccacagcagctggacaaaggaaggtcctcagcctccagtcgcctctctgtgcatgcagtcggtcactgatctcgcctactggtaagtttccccagaagcccagttaacagagaaaaatctgcacagcctctcttggtttctccagtccaaagccccaacattggtccaagaaggctctggcatgtgccaggcacccgataattatctagtcttaaggggacgcctctaagccatttaatcctgttccaggaacaaaaaaggcagcagtgatgatggctccttttatcttctccctccggctgtccaggatggcctccttttccctgttctcccaagcccaccctcccttatgggaaactcccggtcctctgttccaaaaaaaaaaacagtcctctaggctgcctcataaaaaaacctgcaaacattaggcctcaagctagatatgtgccctaagcgccttgtctttttttttttttttttttttttttgcaattcagtctggccacaatatgaattaaataatgggtccaaatggcccgcaaatggaacattcaactttgcaattctaacttatttaagcaattaatgctgacgactggagaaatggcaagaaattccttacgtccaggcctttttacactcagatcacaacctgtcctctgcaattcttgcttatctgttcaaatccttcccctccattctagccgccctaatcacctttctcctcccaaccgtacctctttttttctcattaaatccagcagactgctgtccacccctcccagcccctacctcttcctctcaaccatcttctttaaccccccaagcctcctcattgtcttctcagctgccatcttcccagtcagctgtatccacttatttttctacaccgtcccctcctcagaacaattctaatattacctatacctattctcctccccaacgccctctcctgaggcttgtaaacctatcctgccaccttacgcctctgtctatcctccactgcctattaactcaaccgcgctttccccttcaaaccctcagaaggaatcagtattttaaaccttcagttcatctcctaatccacccccaatgtttggctcaagctccagaagcttgacgacggccgtcaaaccccacaacaagtccttcttaatttagccttcaaagtcttcaacaattgtaatgaggaaagtaaaaggcaaaaacaggcagagtttcaaatgcttgcctccaccatcaggggccctgcaggcccacggggccgcagctccacacagaagcctcctaaaaatccacctccacctggcgcctatttcaagtgtggcaatgaaggccactggtccagacaatgcccaaacccaggtaaagccagcagtccatgcccctctctgcggagaaccccactggaagtcggactgtaagcagctcccacaaggactgcccccatcccttcctgagctagccaaaacctcctacttatatctcatcggccttgccactgaagaatgatggtgccctggaacagacaccctggcaactacctttgcctcatccaagccaagggtaaccctgatggtggcaggtaggccagtatatttttaaattaataccaggcaacctactctgctttacctaatttttcaggaaccacccagtcctcccaggtgtctgttgtaggaattaatggacaagtctccaaacctcgagtcccccctccacttttctgctcccttcacaccttttccttcactcactctttcttagtcctgccctcatgcccaactactctcctaggcagaaatatctttccaaaactccacactactttccacttccacattccccatagtacccaacacatcaacccagacccctctggggcttctaactttcttctactcctccaaccacccaccttaaaacgtgcaactttttcttgtcccccatctgtagttaaccccgctgtttaggatacttccacaccctcagtcgcaggacaccacacccctgtccacaatacccttaaatagcccacccagttcctatcacagaagtagtatgccatcccccaagtagctctcataagcctaaagcctatcatttctcgtctcctctccagtcacctactctgcccaacaaactccccttttaacacaccagttctacctgtgaaaaagctagatggagcttatcacttagtctaggacctcaggctcattaaccaagctgtactcccagtatgtccagtagttccttacccatatactttactttccacaattccctccgataccactcatttttctgttctaaacctaaaggatgcttttttttcataattcctttacactctgattcccaaaacctcttttcctttatgtggaatacccccgacacccacctttcatgtgagctcacctggtgcatactacctcaaggtttcagagacagcccccacttttctgtgtccaaaaggcccttgctcatgacctctgtagcttatccctaaagctgtccactctctttcaatgtattaatgatctgctcctgtgtagcccctctcaaaaaaactgcaactaccatactatctctcttttaaacttcttcccaaaatgcgagtattaggtctcccctaaagaaacaaaaatatgcacccccctcagtcacctatctatgcctaactcttaccccatgaacctgagagctcacaaccgaccacatatccctcctccagtccctcctgcctccgcaaactaagcaaaaaaatctctcttttctaggactagtgggatattgtaggctctgggttccctccttcgctctatctgccaaaccattataccaggctgctaaaggccctctctatgtgccattaaactctgcacagcctattacccaacctttccatctactccagaaggctctcacctcagcctcatcctcactctcccagacctcaccaaacctttctccctctatatcgacagatgatgtaaagttgcattatgtattctaacccagtctaagggacctaccgcccaggttgttgcctacctctctaaacagcttaaagccaccattctccgatggcctgcctgccttcaagcattggtggcagctgctgtcctcacccttgaaagcctaaaactatctctccatgccaacctaacagtttattcaacccataacatcaaaaacatgttagctcactgcagtgtactaagtctcatctctgccccatggctcctccaactgtatgctctattcatagaaaaccccctcctaccaatcaccatactaaccagctcccgtctaaacacagccatgctcttacctgaagttacaaccgcccaagaccctacacacttctgtgtaaacactgttcaaaccttccttataccttttccaaacctaacagaacaaccctttccagatgccccctttacttagtttgtagatggcagctccttcctacatcaaggacgctggcatgctggctatgctatagtgtcaccccacacacacacactattgaagccaatctgctcttgctaagcaccacctctaaaaaagctgaactcgtcgctcttcctcaagctctcactctagcagccagacaacaaatcaacatatattcaaattctcgttatacattctacatagtgtactcacactcgtccatctggaaaaaacgaggcttcctaattgcaaaaaacactcctgccataaatggctctctcatcagcaaactccttcaagctgccaggcttctacagaaagttgccatcatttattgcaggggccaccaaaccccggatgatcctatatcagctggaaataggctagcagatcagataaccaaacaagtagccctccaacccatgcaaggccagtttctgtccctgtcctttttctctcctctttactcctcagaagaaaaggaggacttccaagcccaaaaccttcaaaagcaaggaccatggtatgtcaaggaaaggtgctttattcttcctcactctcaaagccttcctcacctccaaagcctccacaaccctttccatatcagttacaacctctcttgcaacttctctgccctattctcacttgccctcacctttccagccatgtttgagaaattacctagtcctgctctgtctgccactcagtgtcaccccaaggctccttccagccaccttttcctacccaccaagcccagggccaggtacccaggcaaaattaacaaatggacttcactcacatgctggccaataaacggctccactatcttctagtctttatctgtactttctccaggtagataaaagcattcccaacaacttcagaaggtataaatgtcatcacacaaactctcttcatgcatataattctccgttttggacttccaacattcatccagtccaacaacggaccctccttcatcagccaaattatccaaggcatctctacatccttaggtataaaatgggttctccacacaccctataggcctcaattctcaggcaaagttgaaaaaattacgtctgtccttaaagcccaactcaccaagctggctctaaaaactcaccagtcgtaaacaaaaaatctccctttcacccttataagactccacacaacaccaaaagcaccctctttttatagtccctttgaaatcatatatggccaaacttttgtcttggggtctccacccttaccagactctgagccactcagatattacctctcctccttaatccagacatggtctttcattcgtgaagcagcaaataaggccatgcctctccctgttaacacctttttgtcctctgaacgtaactgtcttacaggcacagacgtgtttccagacaatccagatgatgcttctgctacagcgacatggtaaataccaacccgtctctcaacaatacccccaaaattaagattttctttttccaagatgtccacgtcaccccctatgtcatgcctgaagtaattattgagtaagtggtcccttttcccttttctctaaccaaatagacaggaa

SEQ ID NO: 32 - DNA, 7785 bp, Homo sapiens
  repeat_region (1)..(7785): hervi
  misc_feature (7232)..(7232): n is a, c, g or t
aatttggtggcccatacagggaaaacattgtcctccgggaaagggttctttgatcatcctcttgagaggagaacacatcccactgtccttgttgcggtggcctcatgagtaggaatcgagacccacctgtctgatgaataaccccagactctcaacaacgtggggagaaaaagacttgcaacactatggtggccaggtaactctgtgcgcagaccaaggtaagaaatgtcgcaggagtgacaaagtacttccttggtggtcactatattctggtggctgaaagttcatgaatggtaacaagtgctactgctgtgtggagtgaatgagtccaatctgtgggtctatggttacctcatacggcttagccttctctgaaggatcctgatgttggggtttatatagtcctcccaatgctaagcgggacttaaaatattcctaggaggaaagtggccagagtggatgaagcaaaaggagaagagtgtgaagaacctccaggaggtggggctaaaagataggcaagaaatctctaatacgagggattgagccacagaaagctccagacagataaaaaagaaattcctaatatgaggaactgagccacagcaagcctccagcaggcaacaaatccctaatatgagggattgagcctagctaagacccaatatgggaaataccccaagaaagacagagaataagaaggatgaaaatagtaacaaggatataccccttgatagtcccctaggtttcatgttaaaatactggaaagataatgagaggactaagcataagaagaaggagcaaatgataaaatattgctgtttcatttggacccaaggtcccatcctcaaaccctcaatcttctggccaaagtatgggtcgaatgagggtgtaatgagtcaactcctaatccaatatgttaatgataaaagtctggtttctcaagaagaactagactatgctctttgttggaagcagggacctgtcctcctctttcccttaaagacaactagggaagaatccgatccagcatctcaaattgagaagtcagacaagccgactcccacacctaaagtcagcacatgggatcccctagactgtcttcctttgcttactgccccaatcctaacccccctactcctcaggcagctgctgctgccccagatcccatcccagattcttccccaactcatgatgttcctcccgcttacaaccctgactctcaggggcagtcgtcccaagagcctgttcattgccaacctaaatatccttccttaaaagggctccaacatgaaatagagcagtgtaaaaaggacattcagaactccccttttctttccacacctaaggagtcagccataactttcttccctttaaaaggggtatcacaaggaggggaagtcattggttttgtaaatgctctcttgactatttcagaagtctgaggtctgaagaaagaacttaagccactgctagatgacccctatggagtggcagatcaagttgatcaattcttagggacctcagttatacacttgggtcgagcaaatgtctatcctaggctcttcttttcaggggaggaaagaaagcatgatccgtagggctgctatggcaatttgggaacatgaacaccctcctggtcaaaacgttcctactgtggaccaaacatttgctgcccaagcaagactcctggtgggacaacagcaatgcagcccactgagaaaacatgcaggacctaagggaaataataataaaaggaatcagtgaatccatacccagaactcaaaagctctctaaagcatttgatatacaacaggagaaagatgagggacctataagattcctagacagactaaaggagcaaatgaagcaatatacaggtctgaatttagaagatccccttgggcaaaggatgttaaagatccattttgtcactaaaggctggccagatgtttcaaaaaagttacaaaaattggaggactgagaaaaccgacctctaagagaacttctcagagaagctcaaaaggtgtatgtgaggagggacagggaaaaacaaaaacagaagtcaaaaccaatgttatctactttccagcaggtggctccaaacccatatgctactaaatgaggcttccagggagccagaaactataaaaggtcccaagcctcccaaacccagtttagagaaaccaaaccttcagctagaggacccaagtctacatttcccaggccccctaaagagcatagaaaagcaagaccaaaaaatcccaaaactgagagaggggaaggacaagataagtgttacaaatgtggaaggacagcccccttcaaaagagaatgtcccaaattagaaaaggagagagaagcccttccactcacgacctttgaagaggaacagggaagtcaggggctctgtctatattatcttgagtcccaccaggagcccttgataaatttggaggtgggacctacacatgagcttatcacatttttggttgattcaggagcggcctgttcctctgtttgtttcccctcatctaatgttgcctgctcttcagaagaacttatagtctctgagataaaaggggaaggatttacggtgagaatcttagaaaatacagaagtcaagtaccaagactaaacaacccaggttcaatttttgttaatccctgaagcagcaactagtttgttaggaagagacttaatgttaaagttaggcataggcctacaagtcagcccaaagggattccttacttcattaaacttactcaccacggcggatgagaaatacattcatcctgatgtttggtcaagggaagaaaactgaggaaagcttcgaattctcccaatccacatcaagctaaacaccccgcactgggaagtagtgaggaggaagcaattccccattcccttagagggcatgctagggctaaaacctataattgaaagtctcattaatgatgggcttcttgaaccctgtatgtctccttataacaccccaatactgcctgtcaaaaaatcagatgggtcataccggctggtgaaagacctcagagccattaaccaaacagtccagaccactaaccctgttgtccccaacccttacaccattctcagcaaaattccatataatcatcaatggtttactgtaatagatttaaaggatgctttttgggcatgtccctggctgaagagagccgagacacatttgcctttgagtgggaagatccccagttagggtgaaaacaatggtatcaatggacagtcttgcctcaggggttcatggattcacccaacctttttggtcaaattttagaacaagtgctagacaaagtttctgttccaaaacaattatgcctgcttcaatatgtcgatgatattctcatatctggtgaggatatagagaaagaagctggcttctctacacatatttttgaccatctacagttcgaggggttacgggtctcaaagggaaagcttcagtgtatggaacctaaagttaaatatttaggccgcttaataagtgcgggcaagcgaaggatagggcctgaatgggtcgaaggaatcgtgtccttacccttgcctcagactaaacaggaactcaggaaatttttagggttagttggatactgccgcttaaggattaactcacatgccctaaacagtaaacttttataccaaaaacttgcccagggaaaacctgagcatctcctgtggacttctaaagaggtcgatcaggtcaaagagctaaaaggaatagcttataactgctcttgccctagccttaccttccctagaaaatacacttcaccttttcgtcagcgtgaaaaatggggtggctttaggggtgcttatccaagagcacagaggctgctggcagcccatggccttcctgtcaaaaattttggacctggtcacctgtggatggcctcagtgcatccaatccattgcagctacagcagtattagttgaagagagtagaaaattaacctttgggtggagattaacagtaagcacaccccaccaagttagagagctattttaaataaaaaagcaggaaggcgactaactgactccagaatcttaaaatatggggctattctactaaaaaaagatgagagaacacctatgtctagatttaattgactaccaaacaaaactcaggccagatctaggaaagatccctttcaaaacaggacggcacttatttatagatggttcctcccagctgattgagggaaaaagacacaacgggtatccagtaatcgatggagaaattctctatgtataagaacagagtcaagaaaattgcctaataattggtctgcccaaacttgtgaactgtttgcactcagccaagccttaaagcacttgcaaaaccaggaaggaaccatctatactgattctaagtatgcctttggagtggctcatacatttggaaaaagttggactgaatgtggcctcactaatagtaaaggtcatgaccttgttcataaggagttaatcatccaagtactggataaccttcagttgccagaagaaatagctattgtccgtgtacccgggcaccagaaaagcctttcttttgaaagtcgaggaaataacctaacaaaccagatagccaaacaagctgctgtttcctccgaaacacctatgtttcacttaactccttgtcttccttcccctactgcaatttcctttttctcttccattgaaaaagaagaataaagataggagccaaaggagaagaccagaatgaaaacggctgttactagaccaaaaggaaatgttatccaagcccgttatgtggaagatctagtctcaactatatctgaggacacactggggatcccaagccatgtgcgatgcagttctcagggtctatggatgtataagaatttacaccctagccaaacaagttacagatagttgcttaatatgtaaaaagactagtaagcagattctaagaaaaccgccccttggagaaagagattcagggctaagaccatttccaagtgttcaattaattatactgaaatgcccccaattggtcatttaaaatacttattagtaataatagaccactttacctactgggtagagactatcccacactcaaatgcaaccaccagtaacgtagttaaggcattaattgaaaacattgtacccagatttggactaatacaaagcactgattcagacaatggaacccatttcactgcatatgtcattaaaaagttagcccaggtactagacataaaatggaaaaaccatatcccttggcatctctcctcctcaagaagagtagaaaggatgaatcagactctaaaaagccacttaactaaattagttctagaaacttgattgccatggactaaatgtcttcctattgccttgttaagaatccgaactgctcctcagagagatactggcctttccccttatgagatgctctatggattgccctatttatactccactgctaacattcctacattcaaaataaaagatcagttcctcaaaaattatatacttggtccatactctactttctcttcccttaagactaaaggtctcctagcacaggcgccaccgctggagtttccagcacattagcgtcagcctggagaccatgtcctcataaaagggtggaaggaaggcaaactcaaaccagcttgggaaggaccctacttggtgctcctaaatactaagactgcagtccgaacagcagaatgaggatggactgatcacacccgcgtcaaaaaggcgctgccacctccaggatcataaaccgtcactccagggctcaccccaaccaaattaactctaaaaagggcttaataatcacttgtttattttttcttttctttccaacagaaggtcatcttgtcatcaatgtaacttgggctaaccatcctttaatccttcagtttgatgcttgttcagtcatcctgtgtggagacaagcaagctcaaaggaagctgtctcatgtagataagtacctatgtccataccataaaaagtcaaccaagtataagtatagaaccttaaaaagtccctgtggtgactggacagatgtttggaaaccactcagtatggagggtggacagccaggcccccttttcaaataagttatggggactaaaacagaaactccaactaattcatggtcccaccccaccaaactgtaagccactgcagtgtaacccctcattgctaattatagctaacccccaaacaatggcccaagaacccactatattcaaacagtatggattaggagcaaatgttacaaaacaaaatcccataaaaatcttcaaccactggttaacaatgataattaaaaaaaaatccacacccagagtctgggaaacgagtggaatctaacactctctccaagtatagcgagctcagcgtcctcctcccatctccaaaacaacccaactaaagtaacggttgtaaaggtaaaaaatttaaagcagactatagccctagagacaggatgtcaagatgcaaatgcttggctaaaatggattaaatattccatctgcactttaaacaaatatgaatgttatgcttgtgctcacggtagaccagaggcccagattgtcccctttccactcagatggtcttctaactgaccgggcataagctgtatggtagttctcttccaagatcacacagcctggggtgacaaatcatgtcaagctctttctctgctgttccctgaagctcaacaccctgagggtcagcccccgagggcatcagcttccgtttcccaatgccaattttactttgtgtctctcacaacagggagaaaacttggtgttccttggagccttaatgggatgcagtgagcttaagtccttccaagagcttacccatcagtctgcccttagtcatcctcgagcggatgtatggtggtattgtggtggaccattactggacactgccgagtaactggagcagaacatgcactctaattccattggctatccctttcaccctggcatttcatcaaccagaaaagatagaaaccaaacactgtaaaacaagagaggcccctcatgggtctgttgactcccacatttatatagattccactggagtccaacgaggagtgccagatgaatttaaggcccaaaatcagacaactgcaggatttgaatccacgttcttctggtggttaactataaataaaaatgtgaattagataaactacatttattacaaccaantatgatttgttaattatactagagatgctcttaaagggacagctgaacaattaagacccaccagtcaaatggcctgggaaaataaaatagcattagacatgataccagcgaaagaaggtggagattgtgtcattatcggaacccgatgctatacttttatccctaataatactactccaggtgggatcacaccaaaagcactacaaggtcttaccgccttatcaaatgagctagccaaaaattctggactaaacgaccccttcacaaatttaatgggaaattctttggcaaatggaagggatttatgtcctcaatcctcatgtctcttgccatcagaatagggttgcttattcttgtaggatgctgtgtcataccctgtgccctaggattaatacaaaagctcattgaaacagctctccccaaaacctccctcaatcctcctcctcctcgttccagtgagctttttcttttagaagacccaagtagaataacagagccaaattatgttaaaagggtttaagaaaaaatactgtaaaatatttaacagggggat

SEQ ID NO: 33 - DNA, 7242 bp, Homo sapiens
  repeat_region (1)..(7242): hervk
ctggtgcccaacgtggaggcttttctctagggtgaaggtacgctcgagcgtaatcattgaggacaagtcgacgagagatcccgagtacatctacagtcagccttacggtaagcttgcgcgctcggaagaagctagggtgataatggggcaaactaaaagtaaaattaaaagtaaatatgcctcttatctcagctttattaaaattcttttaaaaagagggggagttaaagtatctacaaaaaatctaatcaagctatttcaaataatagaacaattttgcccatggtttccagaacaaggaacttcagatctaaaagattggaaaagaattggtaaggaactaaaacaagcaggtaggaagggtaatatcattccacttacagtatggaatgattgggccattattaaagcagctttagaaccatttcaaacagaagaagatagcatttcagtttctgatgcccctggaagctgtttaatagattgtaatgaaaacacaaggaaaaaatcccagaaagaaaccgaaagtttacattgcgaatatgtagcagagccggtaatggctcagtcaacgcaaaatgttgactataatcaattacaggaggtgatatatcctgaaacgttaaaattagaaggaaaaggtccagaattaatggggccatcagagtctaaaccacgaggcacaagtcctcttccagcaggtcaggtgctcgtaagattacaacctcaaaagcaggttaaagaaaataagacccaaccgcaagtagcctatcaatactgccgctggctgaacttcagtatcggccacccccagaaagtcagtatggatatccaggaatgcccccagcaccacagggcagggcgccataccatcagccgcccactaggagacttaatcctatggcaccacctagtagacagggtagtgaattacatgaaattattgataaatcaagaaaggaaggagatactgaggcatggcaattcccagtaacgttagaaccgatgccacctggagaaggagcccaagagggagagcctcccacagttgaggccagatacaagtctttttcgataaaaatgctaaaagatatgaaagagggagtaaaacagtatggacccaactccccttatatgaggacattattagattccattgcttatggacatagactcattccttatgattgggagattctggcaaaatcgtctctctcaccctctcaatttttacaatttaagacttggtggattgatggggtacaagaacaggtccgaagaaatagggctgccaatcctccagttaacatagatgcagatcaactattaggaataggtcaaaattggagtactattagtcaacaagcattaatgcaaaatgaggccattgagcaagttagagctatctgccttagagcttgggaaaaaatccaagacccaggaagtacctgcccctcatttaatacagtaagacaaggttcaaaagagccctaccctgattttgtggcaaggctccaagatgttgctcaaaagtcaattgccgatgaaaaagccggtaaggtcatagtggagttgatggcatatgaaaacgccaatcctgagtgtcaatcagccattaagccattaaaaggaaaggttcctgcaggatcagatgtaatctcagaatatgtaaaagcctgtgatggaatcggaggagctatgcataaagctatgcttatggctcaagcaataacaggagttgttttaggaggacaagttagaacatttggaggaaaatgttataattgtggtcaaattggtcacttaaaaaagaattgcccagtcttaaacaaacagaatataactattcaagcaactacaacaggtagagagccacctgacttatgtccaagatgtaaaaaaggaaaacattgggctagtcaatgtcgttctaaatttgataaaaatgggcaaccattgtcgggaaacgagcaaaggggccagcctcaggccccacaacaaactggggcattcccaattcagccatttgttcctcagggttttcagggacaacaacccccactgtcccaagtgtttcagggaataagccagttaccacaatacaacaattgtccctcaccacaagcggcagtgcagcagtagatttatgtactatacaagcagtctctctgcttccaggggagcccccacaaaaaatccctacaggggtatatggcccactgcctgaggggactgtaggactaatcttgggaagatcaagtctaaatctaaaaggagttcaaattcatactagtgtggttgattcagactataaaggcgaaattcaattggttattagctcttcaattccttggagtgccagtccaagagacaggattgctcaattattactcctgccatatattaagggtggaaatagtgaaataaaaagaataggagggcttgtaagcactgatccaacaggaaaggctgcatattgggcaagtcaggtctcagagaacagacctgtgtgtaaggccattattcaaggaaaacagtttgaagggttggtagacactggagcagatgtctctattattgctttaaatcagtggccaaaaaactggcctaaacaaaaggctgttacaggacttgtcggcataggcacagcctcagaagtgtatcaaagtatggagattttacattgcttagggccagataatcaagaaagtactgttcagccaatgattacttcaattcctcttaatctgtggggtcgagatttattacaacaatggggtgcggaaatcaccatgcccgctccattatatagccccacgagtcaaaaaatcatgaccaagatgggatatataccaggaaagggactagggaaaaatgaagatggcattaaagttccagttgaggctaaaataaatcaagaaagagaaggaatagggtatcctttttaggggcggtcactgtagagcctcctaaacccataccactaacttggaaaacagaaaaaccggtgtgggtaaatcagtggccgctaccaaaacaaaaactggaggctttacatttattagcaaatgaacagttagaaaagggtcacattgagccttcgttctcaccttggaattctcctgtgtttgtaattcagaagaaatcaggcaaatggcatacgttaactgacttaagggctgtaaacgccgtaattcaacccatggggcctctccaacccgggttgccctctccggccatgatcccaaaagattggcctttaattataattgatctaaaggattgcttttttaccatccctctggcagagcaggattgtgaaaaatttgcctttactataccagccataaataataaagaaccagccaccaggtttcagtggaaagtgttacctcagggaatgcttaatagtccaactatttgtcagacttttgtaggtcgagctcttcaaccagtgagagaaaagttttcagactgttatattattcattatattgatgatattttatgtgctgcagaaacgaaagataaattaattgactgttatacatttctgcaagcagaggttgccaatgctggactggcaatagcatccgataagatccaaacctctactccttttcattatttagggatgcagatagaaaatagaaaaattaagccacaaaaaatagaaataagaaaagacacattaaaaacactaaatgattttcaaaaattactaggagatattaattggattcggccaactctaggcattcctacttatgccatgtcaaatttgttctctatcttaagaggagactcagacttaaatagtcaaagaatattaaccccagaggcaacaaaagaaattaaattagtggaagaaaaaattcagtcagcgcaaataaatagaatagatcccttagccccactccaacttttgatttttgccactgcacattctccaacaggcatcattattcaaaatactgatcttgtggagtggtcattccttcctcacagtacagttaagacttttacattgtacttggatcaaatagctacattaatcggtcagacaagattacgaataacaaaattatgtggaaatgacccagacaaaatagttgtccctttaaccaaggaacaagttagacaagcctttatcaattctggtgcatggcagattggtcttgctaattttgtgggacttattgataatcattacccaaaaacaaagatcttccagttcttaaaattgactacttggattctacctaaaattaccagacgtgaacctttagaaaatgctctaacagtatttactgatggttccagcaatggaaaagcagcttacacagggccgaaagaacgagtaatcaaaactccatatcaatcggctcaaagagacgagttggttgcagtcattacagtgttacaagattttgaccaacctatcaatattatatcagattctgcatatgtagtacaggctacaagggatgttgagacagctctaattaaatatagcatggatgatcagttaaaccagctattcaatttattacaacaaactgtaagaaaaagaaatttcccattttatattacttatattcgagcacacactaatttaccagggcctttgactaaagcaaatgaacaagctgacttactggtatcatctgcactcataaaagcacaagaacttcatgctttgactcatgtaaatgcagcaggattaaaaaacaaatttgatgtcacatggaaacaggcaaaagatattgtacaacattgcacccagtgtcaagtcttacacctgcccactcaagaggcaggagttaatcccagaggtctgtgtcctaatgcattatggcaaatggatgtcacgcatgtaccttcatttggaagattatcatatgttcatgtaacagttgatacttattcacatttcatatgggcaacttgccaaacaggagaaagtacttcccatgttaaaaaacatttattgtcttgttttgctgtaatgggagttccagaaaaaatcaaaactgacaatggaccaggatattgtagtaaagctttccaaaaattcttaagtcagtggaaaatttcacatacaacaggaattccttataattcccaaggacaggccatagttgaaagaactaatagaacactcaaaactcaattagttaaacaaaaagaagggggagacagtaaggagtgtaccactcctcagatgcaacttaatctagcactctatactttaaattttttaaacatttatagaaatcagactactacttctgcagaacaacatcttactggtaaaaagaacagcccacatgaaggaaaactaatttggtggaaagataataaaaataagacatgggaaatagggaaggtgataacgtgggggagaggttttgcttgtgtttcaccaggagaaaatcagcttcctgtttggttacccactagacatttgaagttctacaatgaacccatcggagatgcaaagaaaagggcctccacggagatggtaacaccagtcacatggatggataatcctatagaagtatatgttaatgatagtatatgggtacctggccccatagatgatcgctgccctgccaaacctgaggaagaagggatgatgataaatatttccattgggtatcgttatcctcctatttgcctagggagagcaccaggatgtttaatgcctgcagtccaaaattggttggtagaagtacctactgtcagtcccatcagtagattcacttatcacatggtaagcgggatgtcactcaggccacgggtaaattatttacaagacttttcttatcaaagatcattaaaatttagacctaaagggaaaccttgccccaaggaaattcccaaagaatcaaaaaatacagaagttttagtttgggaagaatgtgtggccaatagtgcggtgatattataaaacaatgaatttggaactattatagattgggcacctcgaggtcaattctaccacaattgctcaggacaaactcagtcgtgtccaagtgcacaagtgagtccagctgttgatagcgacttaacagaaagtttagacaaacataagcataaaaaattgcagtctttctacccttgggaatggggagaaaaaggaatctctaccccaagaccaaaaatagtaagtcctgtttctggtcctgaacatccagaattatggaggcttactgtggcctcacaccacattagaatttggtctggaaatcaaactttagaaacaagagattgtaagccattttatactgtcgacctaaattccagtctaacagttcctttacaaagttgcgtaaagcccccttatatgctagttgtaggaaatatagttattaaaccagactcccagactataacctgtgaaaattgtagattgcttacttgcattgattcaacttttaattggcaacaccgtattctgctggtgagagcaagagagggcgtgtggatccctgtgtccatggaccgaccgtgggaggcctcaccatccgtccatattttgactgaagtattaaaaggtgttttaaatagatccaaaagattcatttttactttaattgcagtgattatgggattaattgcagtcacagctacggctgctgtagcaggagttgcattgcactcttctgttcagtcagtaaactttgttaatgattggcaaaagaattctacaagattgtggaattcacaatctagtattgatcaaaaattggcaaatcaaattaatgatcttagacaaactgtcatttggatgggagacagactcatgagcttagaacatcgtttccagttacaatgtgactggaatacgtcagatttttgtattacaccccaaatttataatgagtctgagcatcactgggacatggttagacgccatctacagggaagagaagataatctcactttagacatttccaaattaaaagaacaaattttcgaagcatcaaaagcccatttaaatttggtgccaggaactgaggcaattgcaggagttgctgatggcctcgcaaatcttaaccctgtcacttgggttaagaccattggaagtacatcgattataaatctcatattaatccttgtgtgcctgttttgtctgttgttagtctgcaggtgtacccaacagctccgaagagacagcgaccatcgagaacgggccatgatgacgatggcggttttgtcgaaaagaaaagggggaaa

SEQ ID NO: 34 - DNA, 7953 bp, Homo sapiens
  repeat_region (1)..(7953): hervk11i
tctggcgcccacgtggtctttcttttttcctaagtgcatgtgggaacccgattccctttggtaggtgcggagaaacgtcatcggttcggtccacagaaacgcttgttcgactccccgacgactggtgagtagtctgtgtatggtccgggttaactatgggtcacgcggagtctaaacattatgcttatctctgctatattaaactcctgttaaaacagggcggggttcgagtgcccatggaaaatatggtcactctattcagggcggtggaaaaatactgtccttggtttcctgaaaaaggaaccttatatgtagaactatgggatcatgttggttcaacattccgggaactggtcccagcaggaaattatgttcccgtcactgtttggggtgattgggccttggtacgtgccgtcctaatgacataccaatcccgtgaccccctgcagttaccacagttttctgaatctggcgatcctccgcctcttcctcagctttcctctcccacacggccttcattatctgctcagcctctcccttcgcctactcctcccccacctaacgatactgaggattcaatgtctaactccggtgactttggcttaacgtcaccccctgatgatcttatttcttttcacgaagagctggtacttgtagctcccgcggccccgactcagacagcccgggaccatatatatgctaattcttccctcttcaaacctttgcagtctttgcctccggagccacctaatggctccaggaccaaactacaatttacctgtaattctgcaggccctcccccatccactgcagcccctcaccctcctgtcgtttcggttcctcaaccggtcactttgccatccactcaacctgcttctctgtacccttcttcacacatggataccagtaatcaccagtacgcttctgcctcttctgctcccccaatgcccctttctcacactctcataccggtccgacctcctcaacctcagtttcccttatctacacatacttttcctgtcacttctatgccgactccgtctcatgtgcctgctcttgaaacttccatgcaatgcttattacgccaaaacaaagaaacaagtggattagaggtgtgggcttatccggtcacgctggaacctcccaatgctcaaggggtacaaatgcgtcgatatgcgccgctcaatcttacctttttaaaagaatttaaggatgcttgtactcagtatggtcctacttctccttatgttaaaatggtattacaaactttttgtactgaggtcattttgcttcctttagactgggaccttttggcaaaagctgttctaactccatctcagcatttacaattccgtacctggtggtcagaggaggcccgtctgcaggctcagctaaatcggactaatggcattctaattactcaggctcagctcacaggctccgatagtttctctgatacttacgcccaattaggctttgatgctcttaccacggaacaagtaacaaaggtgtgtatgagagcttgggataaattacgcgccccaggccaagctcctgtttcttttactactgttaaacagggtcacaatgaattataccctgattttttggctaaattacaagatgctgttgaaaaatctgtctctgatgagcgcgctcaaggtattctccttcgtatgttagcttttgaaaatgcgaaccatgagtgtaaaatggccatgcgttccgtccaacgacaaaatttacctgatcacgaggtgttgcctgcatatattaaagcttgtgaaggcattggatcagagacccacaaagctattctgtgggcacgggccatgaaggacgccaatcaaactggctcgactaattcttttcttggagcctgctataattgtggtcaacttggtcatactcgaaaaaattgcactgttaaaaacttaaaagcggccaagccggctcaacaaacacggccaaatgctcctgctactgtttgcccacgttgtcgtaaaggtaaacattgggcaagtacttgccactctaagtctgatatagatggaaatcccttgccacagaaccagggaaacgggaagcggggccagtcccaggccccaatatcaaatgggacacctcagactcagaccaacgttgcgtttccgcttcaagcggtcccaacgcagcccccagcacaaacaaatttacctacagccaacccagatgggtcccagcctcttcttctgtctcagtacaatgcttgtctacctccacagtagggggcagggcggtcaatctctgtagtaccattcctctaaatttactacctaattctttgcctttaattgtccccacgggggccactggccctttacctcaaggttcggtgggcctggtgttaggcagggcatccacctctgctaaaggtatcatagttcatactggtctcattaattctgattcctctgatgagattaaaattatcgtgtctgccaaggttcctgtttccattccggccggtgagtcaattgctcaattgcttttactacctaatatcgttttaaacaaaggagataagacacgtggccctgggatgggctccggcggtgaaaaggccgcttattggattaatgtaatttctaaacaacggcccacctgcaccatacacattcaaggaaaaaagtttgagggcctagtagatactggggctgatgtttctattatttcctctactttacggccttcctcctggcttaaacatcccgccaacatgggactagtaggtgttggaaaagccgaggaagttcaccaaagcacatttatcttggcttgcactgggcctgatggtcaaaagggaacaattcagccttatatcatgcccatccccattaatcttcggggcagatatttgctggaacaatggggggctgaaattaatattccacataactcttatagtgctcccagtcagcatatgatggaaaacatggggtttgttcctggactcggtctcggtccaaagcatgaagggattactaaacccctcccaattactataaaagaagacagggctggtttaggttatcctttttagtggcggccgctgccacgcctcctgatcctatccctttacaatggaaatctgacacacccgtttggattcagcagtggccgctttctaaagaaaaactggaggctttaactcaattggtttctgaacagttacaacttggaaatgtggaaccttctctttccccctggaattctcctgtgtttctagtaaaaaagaaatcaggcaaatggcggatggtaaccaatttaagggccattaatgctgtaattaaacctatgggggccgtccaacccggcatgcctgcccctgctttaatacctaaaaattggcctctcatagttattgatcttaaagattgtttttttcatattgctttacataaatcggattgtgaaaaatttgcttttactgtaccatctatcaataatcaggagcctgcagctcgttatcaatggaaagtacttcctcagggaatgctaaatagccctacaatctgccagctttatgttggacaagtgctttcaccagttcgagcccaatttccccaggcctatattcttcattatattgatgatattttaattgctgcccccactgataaagaattaattgactgttatcaaattttgagccgctgtgttacagaggctggattacacattgctcaggataaaattcaacagaccactcctgttcaatatttaggaatggtggtcgataaacaacgtattcaacctcaaaaagttcaaattaggagagattctttgaaaactttaaatgacttccaaaaacttttgggtaacattaattatttaagacctactttaggcattccgaaatatgcgctgtctaacttgttttctacgctgcgtggagattccaatctccgcagtctcaggactttgacccctgaggcttcaccggaacgggaattcatggagggaagaatccagactgcccagttatctagagtacagccatttcagccttttcagcttctggtttttgcttcattgcactcccctactgggctaatagttcaacataatgatttagtggagtggtgttttcttcctcattctgtgtcaaaaactttgtctgtttatctggaccaactggccatcttaattggacaagctcggtgtaaaatacttgaaatttccggatttgatccaaatttaattgtagttcctttaaatcggctcaaaattcaagccacctttcaacattccgtactgtggcaaattcacttggctgattttattggcgttattgacaatcattatccaaaaaacaaattgtttaattttataaaaatgacatcttgggtggtccctcgattaaccaaagatcagcccattcctgaggccattacagtgttcactgatggctccagtaatggaaatgctggttatgtgggtcctacagacaagcttatttctaccccttatacctctgctcaaaaggcagagttaattgctgtaattactgccttacaggatttccccaaacctttaaatattgtctcagattccgcttatgttgtacatgccactaaaaatatagaaaccgctactatcaaacatattgataattctgaattggcttctttattttcaaggttacaacaggtggttcgccagcgtagacaacctttctatattgcacatattagatctcataccactttaccgggacccatgtctgccggtaaccataaagtcgactgtttggtctcttttgcaacccaagaagctcaggagttccataatctcactcatgtcaatgctgctggattaaaagataaatttgctcttacctggaaagaggctaagcttattgttcacagctgttctcagtgtcaagtttttgtacttccaaatcaggaacctggcgttaatcccagaggcctaactcctaatgatttatggcaaatggatgtgactcatgttagctcctttggcagactctcatatgtgcatgtttctgtagatactttctcaggttttatctgggctacttgccaaacaggggaaggcatggcccatgttaaaaaacatctgtattcttgctttgcagttatggggcttccacgtcaaatagagacagacaacgcctctggatatgttagtaaggcttttgacttatttatgcaacaatggagaatttcccttattaccagaatcctttatgatcctcatggacagactgtggtggagtgggcaaatggcactttaaaaactcaattggaactacaggtgtgtccaacaaagcataatttaactactccccactcccaattacatttggcattgtttactttaaattttttaaatgttcctaaaaataatactctaactgcagccaaacgccattatacaggcaaaaaattctccctaaacgaaggcaagccagtgttatggaaaaactcccaaaccaatacctgggaacctggaacaattataacgtggggaagaggatatgcttgtgtttcaccaggagatcatcaatcccctgtctgggtgcccactagaagacttaagcttcgtgtgaatactgacaatgaaaaccacagggaaaagacgtccgtgtcagagaccgccctcagacgtggtgagatctgtgccaactcctcagaagctggcacgccaaatcaaaatgggtctgattcaatcctccctgatggcaacggagacccatctaactaatcccacttctcctaattacctttctttttctccttacaaacctaaaaatctcaccatttctattagcctgaaaataacatccctctgttcttctcttcctccttcagcactgaatctcgcttacaataggttttatttaatgattctcctccttatactttctgtctcaccagtttcctctcacactgatttacctgctacacaaaattattcttattgggcttatgtgccttttcctccacttattcgacctctcacctggatggatgctcctgcagaaatctacactaacgatagtgtgtggatgcctggagctacagatgaccattgccctgctcaaccaggagaagaaggcactgcatttaatgttactatgggttataaataccctcctctgtgcctcggacatgcacctggttgtatccatctagaaactcaagtctgggctgcttatcttccggagagatcagctacagagaaatggggacatttggtctccggcctctccctttctcctttaagacaaatgaaagggggagtaataggagataccccatactttcaatataaacctgtaggaaaaccatgccctaaaaattttgagggcccatctaaaactttaatttgggaagattgtgttaactcacatgcagtaatattaaaaaatgactcatatggtttagtaatagactgggcaccaaagggctatttaaaaaacagttgctcctctggcggaaaggaatgcctggaggctacttattttatttcttattgggaggacgaggatcatcatcctactttgcataggaggttcagctcgttctttcccttaaaatgggaagataagggcattaccccccgccacccgaggcctcgtatgatattccccattctgagcccagaacacccagaactttggaaattggctattgccatgtctggactgcgagtatgggaaggggaaacttttctgtctgttgtccccactaccgcccctcacatccgtgattctgaaccccatgataaatcccctttgaacctttttcctctttttgatgccgatcctcctttatgggactccgattggcattacgataattcttatcgacccaggtatgcccctctacctcttcagcatccccaggcacctcggattgcttctttacggtggagaacattgggcattgccaccgccgctcctctccctcagtatcaacgtagattcagacattctgctttgtttacctccaacctgactattcctatacagagttgtgttaagcctccttacatgctgttagtgggaaatatcaaaatttggacgaacaatcaaactgtccaatgcattaattgtcatttatacacttgtattaactcccgttttgactccaggaaaagtgtaatgttggttcgagctcgagaaggaatctggattccggtaactttgcccagaccttgggaatcctccccctcaatacatttaattaatgaagtgttacagcgaattctaaaaagatctaagagatttgttttcactttaatcgctgtgatcatgggcctaattacagtcactgcactggccaccactgccggaatggcattacatcaatctattcaaacggctcattttgttaatgattggcaagccaattccacccaaatgtggaattctcaacaaggcattgatcaaaaattggctaatcaaattaatgatttaagacagtctgttatttggcttggagatcgggtagtgagtctcgaacatcgcatgcaaatgcagtgcgattggaatacttcggatttctgtatcaccccatattcctataacgagactgatcattcatgggaaatggtcaaaggacaccttctgggtagggaagataatttatcattggacataactaaattaaagaaacaaatttttgaagcctctcaagctcacttatccattgtgcctggagctgaggcgttagatcaggtggcagaaaatctttctggactaaaccccacgacttggattaagtctattgggggctccactgtagtaaattttggaattatgtttctctgtttaatcggcttgtttttagtgtgccggaccagtcaaagaatcctgcgtcaaaatcgagagaacgaacaagccttcatcgccatggcacatttatataaaaagaaagggagaga

SEQ ID NO: 35 - DNA, 8116 bp, Homo sapiens
  repeat_region (1)..(8116): hervk13i
tctggtgcccaacgtgggtttctccctcactgtgtgaagttgcactttgagtgcaggactcagcagaggacttttcaacgacagattcctgaggattgtcgtcattaagcttggtggtaagcttgggcactcagagtatctcagggactccatgggacaagccagtacaaagtacttggcctatttaaacacttcataaaaacccttcttaaagaaggagaaatttcagtttcttctgacaagctaattgaactctttgaggtcgtcattctcatttgcccttggtttccaactgagggaactctagaacttaaaagattgggatgaggtgggccaacagtttaaaatcgctcatagaggggaacatgttatcccgccggccatttgcacagtttggtcctcggttcgctccatcttagaatccttgcagccataggaggagggaatggagggtactctacctttgctctcctccgaagaggttgaggaaatcctcagtactctctctccagagggcactgcacaacctgaagccatcattttagaaatggacctccattctgatattcctttggcatcaccaaatacaccacagcctacctgtcctaccgcacccccagtatcgctttatgaggaccttatgaaggatctccttccccagatctaagaaatccctctgaaatgtactatcagcagcccttgtgccggaacctcctgtactgtctcagccctgctgtagggctctcaaccatccatctgttcagcccggttatgaggctgtcaactctatccctgttcggcccagtaatgaggccctcaatgctatctcttcacccaattctgcctttcctcttatgcatcaggctccacagaagcctaacctgcagtccatgcaccagcctggagttcaggccctgcagtccatgcaccagcctggagctcaggccctgcagtcaatgcaacagcctggagttcaggcccctgaaagatcgcaaagcaggcaactgtgcgtcagcctggcttgaagtctctcaacttctatattcaaaaccccaatttcttttctgcttctggtccagtcacaactgctgttgctacccataagcaataggttacatacattcctgataatgacacccctcttatgagggccattctcagggcaagggaatacggggatcccgaggcatggtgtcctgttattctacaatctcctatacctgctgcccccattctagctgcccctgctctggctgcaatggatcagccaccacctgctgaccaagttcagcaggcagctgacgccactgcctctccagacccgcagctcaggggatcaggctcctcagccagtgcaagaagggcctgatgtcccagcagagccagttcctgaaataccttccattcgggctgtggtgcaacctgatcctttacaccctggtcaggtccacctatgacctgctacttgggaaagtttttctttcaaattccttaaagatttcaaagagtcggttaaacaatattggtaccaattcccctttcgtccgttccgcccgaaaatccttagcagaagataaatgcttggtgccttgtgactgggaaattctagcaaaatctgtcttatctaaatcacaatatttacaatttaggacatggtgggttgatgctgtccaggattgagtccgccttaatcagggctctaatcctcctgttaacgttacaactgaccagttactgggaatggggcagtgggctgcaattagaaagcaaactatattgaatgatgaagtcactaagcaactccgaaaatgctgcctgggtgcttgggataagattcaggatgatggcactagatgtccctcctttacagccattagacaaatgcaaaatgaaccatacccctgacttcattgcccatcttcaggacgtggcagaaaaatctattcctgatctaaataaccaacatttggttgtggaactcatggcttatgaacaagcaaatccagattatcaggctgctattcactctgtaaaaggtaaaatcccaccaggaagtgatttaatcacaacctatattaaagcatgtgagggtgttggtggaacgttacatactgctatggtcacggctcaggctatggccagcattagaatgcttggacaatttcctggtaattttcactgcagccaatctggacataccaggaaaaaatgtcctcggtgttcagaccaccaccctgtacaacaccaatcccaaaaggccgtacaactgcgagtcccaccatccacaccatgcccaagatgccataagggcaatcactggacagctcactgccactcgaaattcgacactaatggcaaccctttacagccacttcaaaaccagggaaatggtaagaggggccagcccaggcccctccagacaatgaggcattccccaactcccagccttgccttgcagccagatgagggcatccccagctcaaccaatcgatccaaccactcagtttccacttcaaccattcatgccacaagcatagatgtcacaaccccaacaaggatctcatttcaatgctcgtcccccgccaccacaggatctgcagcagtagatctctgctgtattagagacatttccctttttgcctggagagccaccaatagctgttccacaggtgcttttggcccttgccacctggctctgttggtttattgctcagtcactcaagcttaaatttaaaaggtgttcaggtacataatggtgtaattgactctgattactctggggaaatacacattactgttagttctgcagttccttgccaagcttcagcaggagattgaattgctcaacttcttcttctgctgtacattccactcagatccagttctcataaaagaactggaggttttaggagtgcagataatcagggtaaagtggcttactgggctaataaaatttctgacacctgacctgtttgttccacgcatatacacagaaagaaattcatgggcatgattgacctgggtgctgatgtttccattattgctttacaccaatggcctcgtcactggcccaaagaagtcacattcaccgggttggtgggagttggtcaggccacagaggtttatgaaagttccactattttacattgtactggcccagaggacgaactggtactgttcaccctctacacctattccagttaatctctggggaagagatcttttacagcaatggggtgcacaaatttcatttccacatgctgccaacagtgagcaaagtaaaaacattatgacaaaaatgagatatgttcaagacactggtctgggaaaattggctccaggtattactgcctattcaacctttctataaatttgactccaaagggcttggttattctttttagaagcagtcactgtcaagcctccagatgccatccctttgacttgaaaactcagccagtttgggtggatcagtggccgctcccaaaaaataagctggaggcgctccataatttagtcctggaacagttagaattgggacacattgaggaatctttctctccatggaattcacttgtctttgttatccaaaagaaatctggggaaaacagagaatgctcactcatcttagggcagttaatgctgtacttcaacctctggggacattacaatctggcttaccctcccgctctatgctcgctgagtattggcctctaatcctcatagatcttaaagattgcttttttaacattccactggcctctcaggactttgaaaagtttgcttttatggtcccttccctcaacaatgtcgctcaggctacatgctactattggaaagtcctaccacaaggcatgcttaatagtcccactatttgtcagtattttgtggggcgtgtgcttcaacctgtcagggatcagtttccccgatgttacatcgttcactacatggatgatctcctctgcacagcccccccatacaccattttgatttcctgcttttctgtgattcaacaagccatttcagaagcaggtttgactattgcaccagaaaaaattcaaactacctctcattttcaatatttgggcatgcagttggaagacaagctgattacaccacaaaaagttcagcttaggagagacgccttaaaaactttaaatgactttcaaaagttacttggggatattaattggatttgcccttctttgggcatccctacatatgctatgtcaaacctttttgccacattatgtggggatccagatttacacagcaaaaggtttcttacagaaacctcagactcagagaggctgagtctgagttatgattgattgaacaaacagttcaatggtctcaggtcactagattcaatcccaaattaccttttactattttaatttttcccactgaacactctccaacagggatcatcacttaggaacatgatataattgaatggtgttttcttccccatagctctctaaggacacttactatttaccttgactaaatttctaccctcattaggcaagcctgttcccatcttttatgacttttgggacaggaatctcaaaaaattattcttcccttaaaccgtcaacaactctgacaagcatttacaaattgtgttatttggcaggtaaatttggcccatttccctggtataattgacaatcattaccctaatgtaaaattgttccagttcctgaaactcacttcctggattttacctaatattaccagaagtattccattaactggagccgttactatatttactgatgcttcctctaatggccgtgctgtatacacaggaccatgggaacgcgttcttaacacaggacctatttctgtacagcgagctgaacttagcactgttatgactgtccttgaggattttcctgagtctgtcaacattgtttctgattctgcatacctcgtgcatgttgcccacaacatagaaacggtgttaaatttttgcctgatgaaagtttactttcactttttcaaaagtcttagacagttctcagaaaacactgtgcccccttttacattactcatatttgagcccatacatcacttccaggacctctttcagctgtaaatgccagagctgatgctttagccacatccatttttatggacatgcgaaattgtcgtgccctaactcatgtcaatgctgcaggactcagaagcaagttccctcccacatggaaacaggcaaaaaccatagtacggcactgtccctctggccaagagttaattttacaaccacttccttcggcagttaatcctacaaccacttccttccagagttaatcctacaccacttccttccggagttaatcctacaaccaattccttcaggagttaatcctacaaccacttccttccagagttaatcctagaggcttttcccccaacacactctggcaaatggacgtgacccactttccagcttttgggagactttctttcatacatgtaacacttgacaccttttcccatttcatctgggttacatgccaaacaggagaaagtactgctcgtgttaaatgacatatgccttcttgtttctcagttatgggctgccctgctaagcttaaaactgataacggtcccagctataccagcattgcctttaaaaagttcactcaagcatggggcattactcacactactggaattccctataattctcaaggacagcctctggtggaatgagctaataaacctctcaaggaccagcttcgcaaacaaggtaacaaaaagaaaggggatgtcagtactccccatgctcagataaatttagctctgttcacattaaaatttttaaatttggccaagaaccaacctttcatggcagcagaacaacactttgctggtaataaatttgacccacaaaaaggcaagcaagtatggtggaaggacacaaaaactaataaatgggaattacgcactgtaattaacatggagtaggggttttgcttgtgtctccccaggaaaggaccaacaacctgtttgggttctctccccatcagctgaatttgtaccatgactccagccctgaagaaccatcagaaacaaaaggagaagagccgccagaaatcaaaacgcaaggctcgtcacctgactaatacaatttatatctcaagtttgcctcacagcctcgccctataactcccaatgctaaaattccaccctgctgatgtgggggggtcagataaaagtaatgtccgaagaggttgagagacacctacaggacaaagggattccaaaaactatgggtaatgttatcttggctgcctttatggtagttactgcagtggtaagtatacccggggctgcagcaactcaaaattacacctactggcatatgtcccgtttccattcttattcgatctgtttcatggatggattcctcagtggaagtttatactaatgacagtgcattcatgccagtccctaatgatgacagatttccggcttaaacagatgaagaaggaatgccttttaatgtgtccattggatataaatttccaccattgtgtgtaggatttgcacctggttgtttggcattctctaatcaaaattggatgtggactgtaccggcctccagcaatgattcttatcaggtgcataatgtcttctgtagtaattcttttcaggttctgaccgttaacataaattcatttgaagaacagagaattcctgtcacagtaaagcataataaaacacaaggattgccagactgtttaaaagaccttataaagggacctaataattcaaaacattctatggagtgattgcaatgccccaaaagtagtagtgctaagaagtccgatcacaagtgttgtcattgactgggccccaaaaggatattattggcgagattgctctggccaaaatacccaatgtcctgagtttaactatttaatagattatgaagagaaaggctggcagtcctacaaaaagagggaatgggtgtctccttacccattcaaatggttggacaaggtcatcgttcctcctagaccaaaaatgattcatcctatagttaccccggaacatcctgaattgtggaggttgtctgcagccatatccggaatcagattatggaatgttgcttatcaaaaaattcttacaaataccaaaacaaacatgtataagatctctttaatgtctgagagggtggtacccattaggagctgtgttaaaccaccatatgttattgattggaaacataattatcacccctgatagtcaaactattgaatgcaataattgcaaattgtttacatgcattgatgctacatttgatccaaaaacaagtgttctcctggtcacggccaggaaaggggtatggatatcagtttctttacaccgcctctgggaatcgtctcttctgttcatgtagtcaataaagtccttaaaggattcttaaaagaactaggagattcatttttactctcattgcggtgattgcaggtttaattgctgttactacaacagcggctactgctggagtagccattcataacttggtccacaccactcattatgtggaaacatgccaaaaaaattccacctgactttggaattctcaggctcagactgatcaaaaactggccaatcaaattaatgatctccaccagagtgtcatctggttgggagacaggatgatgaatttagaacactgaatgcaactacaatgtgattggaatacttctgattattgcataacaccttatggttacaaggaagatcaacatagttgggaaaaagtccaaaggcatctaaaagcctgggatgataatttaaccctagacatttcaacactgaaggagcacatttttgaggcttcccaggctcacttaactaccattcctggttctgatatatttgaaagaattacaaaaggactatctgatctaaatcctttcaagtggatcaaacccgttggaggttcacttttgttatcagcattactaatattggtgtgtttatgttgtttgcttttagtctgcaggcgtctccacggagtccaatgaaaaactcgaagccagcgacaagcaatgatggcaatgataatcctaatcaataaaaaggggggaga

SEQ ID NO: 36 - DNA, 5945 bp, Homo sapiens
  repeat_region (1)..(5945): hervk14i
ttcctggctgcccaacgtggggcgacaaagaccccagtgaaggaacgctagagcatgtgaaagcagaggacgcatcgtcaaaggacacccgaggacgtctaaaagaagctcggtgggaaagctgagcgctcggaagaaccagggtaacaatgggacaaagtgaaagcagacattctgcttatttaaatttcttaaggcatttattacgaagagggggagtgaaagttagtactcagaatttgttatcactctttagtgcagtaaagcagttttgcccatggttcccggaacaagggactatggagttggatgaatgggagagaattggcagagattttaaaaaggcgtataaagatggagcaaaaattccagtctcggtttggtcaatgtgggtgctaataaaagcagctcttgagccatttcaaacagatgatgaggcagattcagatgaggaagaggaggacgagtgtaaaaaactaacttcagattctgaatgtgaggaacaggaaacggaggaaattaaagaaaagaaagggaaactgaaaaaagtatgttttactagcccgtcggctccacctgctgaattaagtgaatggccacctcctctctctccccttaatgggcgagaaaatgaattagctacaaaacttactgctcctgtagttgcaacattaaaacctggagcaattggtggtgctatacaaaattctattcaaaaggctagagccgagggagaccttgaagcatggcaatttcccgttactataatccagcagggaggacagaatatagctaattgggccacttttccttttaaattgttaaaggaattcaagcaagccattagtcaatatgggccgaactctccttttgtgcaaactttattaaaaaatatggctcttgataatagattaataccatatgattgggatactttgacaaaatctgttctcactccatctcagtacttgcagtttaaaacctggtgggctgatgaagctcaaactcaggcaagggaaaacacacaagcacagccacctgtgcctgtttcctttgaacagttaatgggagttggccctaattggggtcgattagaaaatcaagcagtaatggaggatgttgccattgttcagctgtgctctgtgtgcttacgggcatgggaaaggataaatgttacaggggaaaaatacccttctttcagttctgtccgacaaggacctaaagaaccatatattgattttattgcttggctccaagaggctgtgtataaagccataactgataaaacagctcaggatgttgtaatacagcttcttgcatacgataatgctaatgcagagtgtcaaactgctattagacccctgagagggaaggctcatttagctgaatatattaaggcttgcgatggcattggaggtaacttacataaggctactcttttagctcaggctatggctggattaagagtaggaaagaatatgccccatttctcaggctcttgcttcaattgtgggcaatttggacacacaagaaaggaatgtagaaaaggaaatcaaaaggcaagaactactaccatcaatcaacagaaaagtcccggtgtatgtccccggtgtaagaaaggcaatcactgggcaagtcagtgtcattctaaatttagcaaagatggacaacctctttcgggaaacaggaagaggggcccgcctcgagcccctcaacaaaccgaggcatatccggcacagccagtgcccttacaaatgtacaacaattgtcccccgcctcagcaggcagtgctgccatagacctctgcagcacaattcccgtctccttacttcctggggagccaccaaagaaggtccccacgggagttaggggacccttaccctcaggaacagttggtctattacttggaaggtctagtctaaatttaaaaggtgttactgtgcatacgggaataattgactctgattataccggagaaattcaattagttattagttcctcgactccgtggtctgcctccccaggagaaagaattgctcagttgttgctgttaccttacataaaactaggaagcagcacagtgaaaagaacaggaggctttggtagtactaatccagcaggaaaggctgtgtattgggttaatcaagtgtctgacaaaagacctatttgcacagtaactattcagggaaaagattttgaaggactagtagatactggagctgatgtctctattattgctataaatcaatggccccggcactggcctaagcaaaaggcatccattggtattgttggagtaggagctgcctcagaagtttttcaaagttccttgattttaccatgtcaagggccggatggtcaggaagggacaattcagcctatcattacacctattcctgtcaatttatggggtagagacttattgcaacaatgggatgctgaaatatctattcctatggatcaatatagtaataatagtagacaaatgatgaaaaatatgggatattgcctgggaaaaggactaggaaaagataaaaatggccaatcagaacctttagaattaaaagggcaaacagatcggacccgattggggtgtcatttttaggagcggccattgttgagcctccggctcccattcctcttgtttggctaactgccaaaccggtttgggtggagcaatggccactgaaacaggaaaaactggaggctttaaaagaactggtgcaggaacaattgcaaaagggacatacagagcctactttctccccttggaattctcctgtatttgtcattaagaaaaaatcagggaaatggagaatgttaacagatttaagggctgttaatgctgtgattcaacccatgggtgcactacaaccagggctgccctccccaacaatgatcccaaaatactggcctctcatagtaatagatctaaaggattgctttttttaccattcctttagctgcccaagattatgaaaaatttgcttttactgttcccgccataaataataaagaaccagcggacagataccattggaaagtactgccacaaggcatgctaaatagcccgactatttgtcaaacttatgtcgggaaagctattaagccagttagagaacagtttaaaaaatgttatattatccattacatggatgatattttgtgtgcagctgaaactagggaagaattgatgttgtgctacaaacagttagaaaaggctgtaaatgcggcagggttaattatagcccccgataaaatccaaacttctactccctttcaatatctaggaatgaaggtagagcaaagtgctattaagcctcaaaaggttcaaattcgaagagataatttaaaaaccttaaatgattttcaaaaattattaggagacattaattggattcatccaactttaggcattcctacctatgctatgtctcacctcttttctactttatgaggtgattctaaccttaacagtaaacgctccctgtccaaagaagcattggaggaacttcaattaattgaggaaaaaattcagcaagcacaagtagaacgaattaatctgatacagccattacagtttttagtttttcctactaagcattcgcctacaggagttatagttcaacaggatgatctggttgagtggctttttctacctcacaatacaaccaaaatgctcactctgtacttagatcaaattgctgtgctagtaggacaagcgaggctgcgcacaacaaagctaatgggatatgatccaaatcagattatagttccattaactaaacaacaaattcaacaagcctatattaattcccaagaatggcaagttaatttggccggttttgttggcattcttgataatcattatcctaagtctaaaatcttccagtttctaaaattaacatcctggatattgccttctattactcaaaaagcccctattgaaggggccattactgtttttactgatggatctagtaatggaaaagcctcatttgcaggacctcaacaacaagttttgcaaactgactttgcttctgctcaaagggctgaacttatggctgtgataacagtgttaaaaacttttaaacagccagtaaacattgtttccgattcagcctatgtagtgcaagccacgcaaaatattgaatgtgccttaattcaaaatgtgactgatgaacaacttaatcttttatttcattctttacagcaagcggtacaacaaaggcattcacctttctatatcactcatatgagagcacatactaacctccctggccctttaactaaacttaatcaaagggcggatgcattggtgtctgcagtctttgctgatgcacaaacatttcattctttaacccatcttaatgccgcaggccttagaaaaagatatggtctatcatggaaacaagctaaagaaattgtgcaacactgttctgcctgccaagtcctgcatctgccacatcaaggaacaggagttaaccctagaggtttatctccaaattccatctggcagatggatgtaacacatattcctgcttttggaaaattgtcctttgttcatgtttcagtagatacctattcacattttatctgggccacatgtcaaacaggggaggctacagctcatgttaaaagacatcttttatcttgcttttctgttatgggaatcccagaaaaaatcaaaactgataacggcccaggatactgtagtaaagccatggctacattttttcaacaatggaatattacccatactacgggtattccatataactcacaaggacaggcaatagtggaaagagctaatcgtactttaaaaactcaaatacaaaagcaaaagggaggagaccaggaatataagacaccgcatatgcaattgcatctagctttattaacattaaattttttaaatttacaaaaagatcaacccatgactgcagctgaacaacacctgacaggacaaaaggaaaataaaaaggctggacaagatatatggtggagggatgcacatacaaagagctgggaaaaaggaaagataattttatggggaagaggatttgcttgtgtctctccaggtgacaatcaggtgcctgtgtgggtgcccaccaaacatctgaagatctatcatgagccacagcatctagtggacccacctgtacagtgcaaattgaaggtttgaggattgcttttaagcctcgatttgctttctctgtgccttctgttagaaggggcctgtttctcattatcagtggtaagttttaccccgtggtaattaaccaaagaggcagaagctgagttacaaatgcttcagcaatggcatgcctcccggctacagccacaaaagtttttgcttctgtttcagtagatttactaacgtgggggtgagggtatgcttgtgtttttgcaggagatgaacaaaccatgtgggtgccctcaagatgtgtacgaccatggaatgggagactggagggacccatggatcccaaccatggactgggttcccccagtacgagccatgagccagttgaatctgaatgcgaagatggaacgaggaccgaccagagtcttaccgatgcttaacggaccaatgctttctgactgagctcctctctaccctgaatacaagagaccctaatagttaggcaggagtatcatcgcccctattcagcatgaagaagttacagaagatggaccttcatccttctgcaacccctaggattaagggtcctcttgtaaaagggaaaggggagatatgtgggaagcattcaaaccagagcgactccatttttaataagggctaagaaaaatgaagctggatcaccaaccggcaattaagggctgcacagcctgcaattgccttgctcaattaatttaaaaagaggccaccttatgctagtaataatgatagcttctcttttacaaaaaagagaaggggggca

SEQ ID NO: 37 - DNA, 6837 bp, Homo sapiens
  repeat_region (1)..(6837): hervk22i
ggtggtgccccgcgtgaggaacgctgcaaacggatcgtgacggacccctcgaaaatgaaggtgaaaagaactgcgcagtcagtgagtaatcagtaagtcattggtgcccgctcgggatttccaagttcggggggaattgttcaggctagggtttcatcatgggacaacagttatcagctcaacagaaacagtatataaaagtattgaaacagctgcttaaagctagcggagcctcagtttcgcaggctcaattaagggacctaatgcaaactgttgtttcccataacccatggttcccggaagaaggtacgctagacgtagagctctgggaacaagtggggagaaatcttaaacaacatcatgcacaagggcaacgggtcccagtaacatctttaacgttatgggccttagttagggcggctttggtcccgttatacacagaagagcctaaaaagggaagggaggaggaaccgtcacctaccttaccacctcctcgtccctcagccccgctatcaccgggccaaaataacaaagaggaaacggaggttttgcctgagccccctcctccaatagattggaaaaaagacaggggatacgctacagctatgggaccctgtcttaagcaagcggcattagaaggggagctcttagcctgcccggtaatgcaagatcgacaaggcaatcaggtgtatgaacccatttcttttaacgcttataaagagctaagaaaaagcattaaagaaaacggagccgctagcccatttatgaaaggaatgattgaagccatggcagacaacttctgtatgaccccatgggactggtcagtgctagctaaaacaactttggagcccagccaatacctcctctggaaggcagaatatgatgagttgtgtgaacaacaagccaaccagaatcaggtggccaggcaagacataacagctgctatgctccaggggaggggtccccatgccgatgtacaacaactagattttgatccccaggcctatgcacaagtgtctttgtgtgctctcagggcttgggaccgaattcccgaaagcggagttcaacagggatcttttataaatgttcaacaagggcctcaggagccatttgttgaatttatcaatcagttaacccaggcaattaagagacaaattagtcacgcccaggccgctgatatcttattgttgcaattggcttatgaaaatgctaatgtcgatcgccagcaagcaatgcaggcaatcagaggaaaggcagccacagtcggggaacttatacgagcatgtcaactggtggggactgaaacacacaaagccaaaatattggctatggcattaaggcctcctaaagtgaaaagggagagaaacccaaattgttttctatgtggagagccaggtcatatgaagagggaatgccccaataatagagaccaaggtaactcaggaaaagaacccccttctatatgcccccaatgtaaaaaggrgaaacattgggcaaatcaatgcaggtccaaatttgayaaaaacagmaaccccataagtaaccaggcgggaaacttcatgakgggctggccyyaggccccgctwmaarctggggcaatgccagcagctttcctcggtcagatggaaagcccacagtcctctctctcagagcagccaccactgggagcgcaggactggacttactctgccccaacaaattagtgctaaaagaaggagaagaccctaaaagggttgcaaccgggatctggggcccactgcctccgggaacagtgggattagtcctagggcgatcaagcctatccagtaaaggaattaatgtgctcactggggtaattgatagtgattatcaaggtgagatattagttatgatggaatgtaaaggtctgcatattcttccccctggatcaaagatagctcagttactgctyttaccatactgggtccccaacgcccacggaaaggaaaggggaaagggaagttttggaagcacgggagccacaggagtatatgggaaycaattaatcactgatcagagacccatgattaccttaaaaattggaaataaaaattttactggcttattggacacaggggtggatatttcaatcattagtgatcaaaactggccagaaacttggccttgggtcactcagaaacaaaaaattgtcagcatcggggaagcgcacacagccaagcagagcacgcgccccctaacatgttgcgattcggagggaagaaaggcagttatacaacctctaatcatgcccatccctgttaatctttggggacgggacctattagcccaatgtggggggtcactctgcagacccctttctaataatggccactgttattattcctcccctacccctgacgtggctctctcaagatccaatttgggtagaacagtggcctttaaagggagagaaattacaaagagcccatgaattagttgaagagcaattaaaagccgggcatatagaaccatcaaacagtccttggaattcgcccattttcatcattcccaaaaagtctggtaaatggagacttttgcatgacttacgtgctattaatgctaatttgcaacctatggggccccttcaacaggggctcccttcccccgcggcgattcctcaagattggcctataatcgttattgacttaaaagactgcttttatactattccccttgcagaacaggacagagaaaaatttgcgtttacaataccagctatcaataatgaaaggccagcttgctgatttcattggaaagtgcttcctcaaggaatgctaaacagtcctaccatgtgtcagtatcatgtaaatcaagctttgctccccagtagaaaagaatttcctaattgcaagattattcattttatggatgatattttacyagcagccccaacggagccagtacttttaartttatatacctctgtcgtaaagaatacacagytaagaggtttaatcatagcacctgaaaaagtacaaatgtcctctccttggaaatatcttgggtacatactaacttcccggtcagtaagacctcaaaaggttaaattaaatactagcaacttacacaccttaaatgattatcagaaattactaggcgatattaactggctttgccccaccttgggcataactacttataagttgcaaaacctgttttctatcttaaagggcaatacagccctagactctcccaggtatttaactcctgcagcaaaaagggaaattgaggaaatagagcaagctatttctcagaggcaactagatcgcatagacccatgatattcagttcagttgtttgtttttcccactaaacattccccaacaggattaataggacagatggccccagggctgcgctttctagaatggatttttttgctcacataccgggactaaaacactctctccctatatccagctaattagtaaagtcatctattcaggccacagacgatgcaatcagttgctaggttatgaccctgatatcatcagaattcctttaagtaaaaagcaattcgaagcagtattgcccttatctttagatctgcaaatagcactctctgattacgcaggccatatagagcatgcccttcctgctgacaaactacttcagttcttatctcatactcctgtggttttgcctacaaaaatagttcactcccccatacctaacgctttaacactgtttactgatggctctggtaaacatggaaaagcggctatttggtggagaccacataattccctcactcattctggatttactagcactcagagagctgaggttggagccttaatattggccctggagactttttctgctcagcccatcaatattgttagtgactctgcttactctgtttatttattgcagaaccttgaaacagccctcattaagtccactctggagcccaccctgtgtgcactttttctttgacttcagcaattgctggatcaacgtacacatcctatttttatcacacatattcgagcccacagctcactgcctggcccactggcttatggcaatgatcaagcagacctgcaggttatgacgtcactgcttgaccaagccacccaatcgcatcaatttttccaccaaaattggagaaacttatctaaacaatttcaacttacccaragactagctaaacaaattatcctgcaatgcccagattgccagctcacaggcacgtcccctccttcaacaggtgttaaccctagaggactagaacctaatcagttatggcaaacagatgttacacacgtccctgaatttggaaaactaagatatgtacatgtatccattgataccaattctcatctaattagcgcacatgctcttcctggagagtccacccgatatgtcattaaacatcttcttttaacttttgcatttatggggcggcccacaaaaattaaaactgataatggtctggcttatgccagctcacaatttcaacaattttgtcacacatggaacatccaacattccacaggcatcccgtataacccccaaggacaggccatagtagaacgtgcccattccacccttaaaaatatgctcagaaaacaaaaaagggggaatatgagtaaggaccctgcaacactattggcacaagccttatttacccttaattttttaaatttaaatgataaatttcaatcagctatagaaaagcactttgctaaaacctctcaagacataaaacctgcagttttatggaaagatgtaaacagtaatgtatggtgtggtccaaatgaattgttaacatggggaagaggatatgcttgtgttcacaccccctcaggtcctctttggattccagcacgacgcatcaaaccataccatggcatggctaggacccaacccagtaccagaaatgaagaaaatgaccctgcaggacccacagccccggacgatgcagcttcctcggatgacacaagccccggacattacctgggggatgctgaagaagacaactcaggaggccgagcgaatcctgctccagacacagacaccattcactccagataatttgttccttgctatgctctctgttgtacattgcaactcatgtagggcattgatcctttttatgctctcgctttgtctgcaacctgtacctgctacactctattgggctcatctcttagatccgcctttcttccgccctgttacctgggcagacactcccttcccagcctctaataacgtaactgcttggctaggagggatagatttacccccagtggggtccctcagtaatggcacacattggactaaggtgccaggtaacactacatatcactccactatcctcccactgtgtgtaagttataaaggttctaacccttactgtgtacctgcccaaacacaattatggctacatcatggcaaaggaaatgcctttacagtcttagctgcaggtagcctcaaaccaggcaatgcaatcaatgccactttcccaaacattccttcctgtgctaaagaacaaagctgggaaagtaatggattccactttagctgggaggtctgtcacgggggacaagcccgtagcctccagttaggcaattataacatcttagactggagtccccacggccatttgcagggcaatcttactgatgtcctcatctatcatggcatcaatcacagtttcgtagccacgtcccgttcccctatratttgggccgatggggggatgggatatcccagaccccaagtaaagtccatgccaccccaagacactttatggtgcctgggacatcttagcacctcccttaacacctggcatgggacatatcataattccagtcacaattatactatgacctttattcataatcacactgatcagtgcctgatttgcactacccatccatatgttttccttatgggaaccgatatttccgttacaccccaaaactccacgtttgtgacccgggtgcagggacaggcttggttcgcctcatgtatcactaattataatatatctaatttaaatattactagtgtcatggtattgaggagacaatctgaggctttcctaccagtcaatttaacatgcgattggcaaggttcctctgcccttgccaccttagaatgtgccctgtcccaggtcagacgcaaaagattcatagttacacttacagcctttatagtctcagccatagtcatcctagcaactgctagtgttgctgtagcatctattactgaatcagtacaaacagctacttttgtagataatttggccagaaatgtgtctaatgaacttctcttacagcagggtayagatcaaaagattcttgcacgtctgcaagccctcgaggctgccttggaatatgtaggggagcgacaagatgcactggcattccaacagcaattaaactgtgactgggagcataagcacatctgtgtcacctctctaccttggaatcaatcaatacatagttgggatgaggtgaaacaacacctctggggaacctttcatgacaatttaacagcagacgtaaagcaacttaaaactaaaattctagaatccctaaacgccatagatctacacgcccaacaaacagccatatggaagggtgtgcgagatcatctctcctggatagacccccgctcctgggggtcactccttgattggaaaagaatgttgctaattatactcatgtttgtcttatgttatttactaattctaggatgcaaagccggaatacgagctataaccgccgcgcctgacagacctgttgctgcacacatctgtactcttcaatcaacaaaacctgatgcaaaaaacagaaaagggggaga

SEQ ID NO: 38 - DNA, 7242 bp, Homo sapiens
  repeat_region (1)..(7242): hervk3i
tagtggcgccccgaacagcgacagaatcaggcgctcaacaagtggcatccgaacacagggactttgaggacgtgaacgaagaaggtctgctggagcagagaaactgaaattgacaagacgaatggggaccctgggatgagtctgctggcagcagatataaggtcagtgccctaacgaggtactgggagcaatataaggtcagtgccttaaagaagtactgggaatgggagtttttctgaatcggaggtaacatggggcagaatttgtctgttgaggaaaaacattatcgtgcagttgcttaaagttttgttgaaacaatctggtgctcaggttaattctcagacattaactaagatgctgcaggaggttattacgcataacccatggtttccacaggcaggcactcctgatgtagaaaattggcacagagcaggagaaggattaaaacaggctcatcaaaaaggtcttaaagttgattcttctgctttctccactaggagtttagttcatactgtccttctgccattatatcctttttattctgctggacagcaggagtcatgttctgagtctaaaaatctgaaagaatctgttgtcccacccacagcaccaattgaaaataaaaaacaggagagggaggataaaaattggcctataccgccccctccagttgcagaaacatctgtaccgcctccttcagtagccgaaatagagacctcaatacaaagaattttatgctctgctgccatagctggagagcccttaggacctctgcacttttcctatttccgtaaggcctgatccaaacaatccacagcagtttattcatgaacactccccactagagtttacgttgttgaaggaattaaaaattaagtgtaattaataatgggatacagagcccattcaccttaggattgctagaatctgtatttggtgctatgcgccttctaccctttgatgtaaaacatttggctcgcacttgtttgtctgctactgcatacctgacttggaatttaaattggcaagaaatgtgtgcagaccaggctagacagaatcatgcttctggacacggagacattacagagggtatgctgttaggtaatggccctttattcagacctggcatgtcaaatggcactcccagatcctgcttatcagcagtgtgcacaggctgctatgcacgcctgggccacaattccagaagagagagtcccagtacaatcctttttacatctcatgcaagggtcacaggaaccctacgtgcaatttcttgcaagattacaagaggcagtgaagcatgaaattcctcataccgctggcacagaaatgctaaccttaactttagcttttgagaatgcaaacgcagattgtaaacgtgcactggcacctgtgaggtgtaacaaaacttgggaaattttctcagaacttgtcaggatgtagaaactgagcttcattgctctgcaattttagctcaagcaatggctaatttagtagttgacaaatctaaaaggagccgacggtcaaaccctaaagtgggaaaatgttataattgtggaaaaactggacattttaaaaaggaatcatgactgatctcagggcagaaaggaccttataatgtggtgccctccacccccatggcccagcggaaaaaaacgccaggactctgtcctcactgtaacaaaggaaatcactgggctattcaatgccgctcaaaatttcatcaaaactgcaaccacctgtcaggaaacgagaagggggcctggacccgggcccctcaaacaatgagggcattcccagttcagaccacaaccccacttcaggggtgggtcccaggaggaacattgattccctcaccccaggaacaccaggaagtgcaggattagatcttccagtcagagaaagaattacattaattggtggagacaaacctatcaaagttcccattggcatttggggacctttaccagcaggatacagtagactaattttaggcaaaagctgccttaacttgcaaggcattactgtagtcccaggagtagctgactctgattatgaaggagaaattcaagtagttttaatgtcacaagatctttgggtttttgaaccggaagaatatattgctcaattattgcttattccctgcaaattacacccttctccataaaaggagaaacgaggaaataaagggtttgggagcacaactacatgagaaatctaatgattcacaacctatagcttataatagacccacctgtgtagtacaaagtaaaggaaagaaattgtatgggcttatggacacaggagctgatgtgtcagtaatatccagtaaggactggcccccagcatggcctctcagactaacctccacatccctagtgggagtaggagcagctaaaagtgttcaacagagtgctgagattttaccttgtcttggtccggatggacaatcatgtactttccagccttatgatgcaaatatagctatcaatttatggggtcaagaattacttacagcatgggatatgagacttacaaatgaaaactttcataacccaggatttaaaatgttgaaggacatgggatatcagagtggaaaaggtttagggaaattcctacaaggaaaccctaacccgatatctataactggagaaacagatagaaaagggcaaggatgtcaggatttctgatggggatcattgatatttctcctcgacccactgccttaccattagaatggctttgtgacaaacctatgtgggtggatcaatggcccctaacacaggagaagctagatcaacttcatctgttggtaaaagaacaattgaatgcaggacatatagagaagagtttcagcccctggaattcaccggtatttgttattccaaaaaagtctggaagatggtgactactacatgatttgagagttattaatgcgcaaattaaaccaatgggtgccttacagcaaggtctaccttccccagcagccattccaagagacaggcctcttgtagtaatagatcttaaggattgtttctttactataccataacacgagaaggataagcctcaatttgccttctctgtgtcttctattaatcatagagaacctgtctctcgctatcagtggaaagttttaccccaaggcatgcttaacagtcctacattatgtcagcattttgtaggaagagcattaaaggagccttgaaatatgtttcccactgtctatatcattcattttatggatgatattcttttggccgctcctacagatcaaattttacatcagttattcagagaaacaaaacaggccttaactaaatggaatctcaaaattgctccagagaaggtgcaaacaacttccccataccagtacttaggaactattgttatggaggggagtgtacggcctcagaaagtagttctccgtaagggcaggttacagactttgaatgatttccaacaattattaggggatattaattggctgtgcccaatgctaggtattgctacttatcaactcacacacctttatcaaaccctccaaggagattcttcattagattctcctcggcaatttactaaggaggcagaagctgagttacagcttgtagaacagatgcttcagcaacaacatgcctcctggctacagccacaaaagcctttgcttttgtttattcttcctaccccccattctccaacaggacttttaggccaattcatagacaaatctgtaatcgtaatagaatggctctttctatctaatcagtgaaatctttgcaagtttatctttctttaattactcaacttataacaataggtaggcataggtcaaaaatgcttatgggatatgatccagataaaattattgttcccttggattcccaacaacaggccacagcatgggaaatgtcgactgcatggcaaatcacttttgcagattttgtgggaataatagataaccattatccatcagacaaaattttgcaattttataaagttcacccttttatccttcctgtaattactcatcacaagcctattccaggtggacagacttattttactgatggctcttctaaaggccgtgcagctatttatggacctaaacatactcaaacaataatgacctctggggtttcagctcaacgctcagacttaattgcagtcattcaggttttacagctgacagcttcagatcctatcaacattgtctgtaattcagcttatgttgtaaatgtagccagttgcatagaaactgctacaattaaaaatacactagacccagaactgcttaatttgtttctaagacttcacacagctattggctctccttcgtctccttttcatatttctcatattcgctctcacacacaacttcctggaccactatctctaggtaatgatagagcagataaactgatgagttctgtgtttcagcaagctcaagcgtctccatgcatttctgcaccaaagtacttctgcctctactcgcatgttccatttstctcgcagccaagctagggctataatacaagcctgtcctacttgccagcatgtccctggagccgcacctgtagaaggttgtaacccatgaggtttggctccaaatgaaatctggcaaatggatgttacacaagtagcagcctttagtaaacttagctatgttctacgaattatagacacttattctcatatgctgcatgctacatgccaaacaggtgagacagctggtcatgtacggcaacattgtttgtcatcatttgctcatatggggatcactaaacaattaaaacctgacaatggaccagcttatactagtcatgcttttcaaatattcttacagctttgagctataacccataaacaaggaatccattataatcctagaggacaaggaattatagagttggcacatcaaacattacaacaagtgttgaaaaaacagaaagggagggataggagaccacttcacacctcaaacaaaactacacttagccttattatctttaaatttttttgactcctggtagagatggtaagactccagcagaaagacattggcaagtgttagaggaaaagaggaaagtttatccgaaagtgttattgaaatcccccggagaagagacaatggaaaggtctgttggatttactgacgtggggatgagggtatgcttgtgtttttcagggagatggacaagccgtgtgggtgccctcaaggtggatgtgaccatggaacgggagactagaggaacccagggtggccaactatgggcctggtccctctggtctgagccatgagccagctgagctagagtgcaaagatggagagaaggccgaccggagtccagacgacatcaacccccataacctgggagcaactcaagaataccaatcaggaagctgggaaactactggagcatcagagccaggcaaaacaccctgattccatgttcttggccatgttagtcataatgtcctgtgtggtatgttttccctgtgcagaggcaaaaacattttgggcatatgttcccaatcccctagtagtacaacctatgctttggagtgacactcctcctgagatttatcgtgatcaggaagtatgggctccaggacccctaactcccctgacaatagaacagttagactctcagaacaatgtcattaattatacgaccccacgagaaggactcctcttgtgtatcactacaaagacatcgcttaactgtagctgtcttataattcaagctcaacaatggttgagtcactatggaaaagtcatgtgcctattaagtcttggttctattaatgtaacaggtgtgctaaccaaccattcccggcccaatcaccctaatcgtgctgactatatggaatggattcccttcgatagttactaccccccctcacatggacccaatgtcttgacccactggctagaaaacaatctatgttaagtggagacattgtggattggggacctaaaggtcttctgtatggaagacatgaaaatcagaaatcatggcacaaacttcgctggcattggtgggaagattttaaagcttcttctttataccacaccgggatctaatcccagtctgccacccagattgcttgacatggagcaggctttagcccgcctcttcctcagtggcattatctagggaggaaaggaccaatccaagagatgttatggaaggcagcactcccatttatgaatggagcatctgggttcgggatactatccagtgatagcaatagtaagcaacacagtcttaatgttacatttgtaaagaatatcaccactcaatttatggtttgtctttttaatccttatgcttttttggcgactaagaaggaccagctccaggtaaacaatatccaattgacctgtaaatcttgccagttatgtcactgcattaatcatagcacattgcaaacacataatgtctctactttgataattttgggtcgcatccctgggctatggattcctgttaatctgtcccagccttgggctaccacacctgctttgcactttatgaaacatcttctaactcagcttactcattgtgcccgtagagccttaggcatgataatttttgctattgtttccttggtcacattaataacttccgttgtgatgtcctctgtagctttgcatagttctattcaaacaactcagtacatggaaaactggatgcgtatagccaaccaagcatggccacttcagaataaaattaacactgagttacaaactgaagtggcattgttgaaatccacggctctatggttaggagaacaagtacaaagcttgcaattgcaacagcaattgcatgatcattttaatcacactcatatttgtgtaaccaacttagaatataaccaaagtgagtatccatgggaccttgtgaaagcccatttgcagggagcttgcacatccaacatcacctttgatatcggtgaattacaaaacaaaattcttgatttaaatggacaaactcaagagtttcagccttctttagaagacgagaccaaattccagcaaggcctggagagcctcaacccttggaccagtctaaagcaccacattaacatcttatatgtagtccttggaataatgttgttttgtctctgtcttctgttcatagtctgtaaaactggatggactgccaatcagaaaatgagagctgcccagcctgaccttacattctttcaattaattcataaacagaaagggggata

SEQ ID NO: 39 - DNA, 5937 bp, Homo sapiens
  repeat_region (1)..(5937): hervk9i
agtggcacccatacgtgggggctcgaatccaggttgaagggtcgccagagcgacggttggagaatggagaactaagctggaggacacccgagtactcttaaagcaatccccgtggtgagtaagaaggggagctcggaagcgtcagggtaacaatgggacaagtgtgggctctggttcgttccaccttggaactttttcacactgatgatgaggaggaacgagagtatagcgaagtaacagaagaggttacagagcaggtttatttgccagctaaagctaaagtggcaaaggaggaagaggttcatccctacccttctgcaccccctccttattattttgaagaaaaagagtggcctgaccctccagatctttcttttccggaggacactgggcgaaaagtagttgccccagtgactgttcgagcagcgcctcgagcgaccgctctcagttctattcaggcaggaattcagcaagctagacgagagggtgatatagaggcttggcagttccctgttagaatacaccccccagatcaacagggaaatattatagctacatttgagccttttccttttaaattactcaaaaaatttaaacaagcaataaatcagtatggaccaggttctccttttgtaatgggactgttaaagaatgttgctgtttccagtcggatgattcctactgactgggacactcttactcgagcttgtctaactcctgctcagttcttacaatttaaaacttggtgggcagatgaagcttccattcaggctgctcgcaatgcccaggcccaacctcaaattaatataactgcagaccaacttttgggggtcggcggctgggctggtttagatgcacaagtggtcatgcaggatgatgccatagagcggcttagaggagtgtgcattagagcttgggaaaaaatcacttcaggtggagaacaatacctttcctttagtgctataaaacagggaccaagagaaccgtacgttgattttatagctcggtatctcttaatacaggagtctcttaaaaagatgatttcagattcggctgctcaggatatagtgttgcagttattagctttcgacaatgctaatcccgattgccaggctgctctgcgacctatcagagggaaagcacatttagttgattatatcaaggcctgtgatggtatcggaggtaatctgcataaagctaccttgttggcacaggcaatggcaggactgagagtggataaaggaaatactccatttcctggagcttgttttaactgtgggaagcatggtcatactaaaaaagaatgtagaaaaaatcagcgagtcaggccaccagataggggaaaaaagaaaactgctgagcctgaaatatgtccaaaatgtaaaaaaggaaaacattgggctaatcagtgtcactctaagtttgataaagaagggaacccgatttcgggaaacgccatgaggggcccgtcccgggccccattctaaactggggcatttccggctcaggccattccctcacccctgtacaatgtctgtcccccgccacagccagtagtgccacagtagatttatgctgcacaaaagctgtgagccttctgcctggggaacccctgcaaaaggtcccaacaggagtctgtggacccttgccagcagggacgataggattacttttaggaaggtctagtttaagtttaaaaggcatacaaatacatacaggagtcattgattcagattacaatggggaaattcaaattgttatatctacttctgtttcctggaaagcagagccaggagagcgcatagcacagctcctgattgtgccgtatgtgggaatgggaagaagtgaaattaaacgaacaggaggatttggaagcacaaataaacaaggcaaagcagcttattgggtaaatcaaattactgataaacatcctacctgtgaaataactattcagggaaagaaatttaaaggtttggtagatacaggagcggacatttcaatcatttctctacagcactggccgtctgcgtggccaattcaacccactcaatttaacatagttggagttggtaaagcccctgaagtatatcaaagtagttatattttgcattgtgaagggcccgatggacaacctgggactattcaaccaattataacttctgtacctataaatttatggggaagagatttattacaacaatggggagcacaagttctaattccagaacaattatatagccctcgaagtcaacatacgatgcatgaaatggggtatgtccctggtatgggactagaaaaaaatttgcaaggtttgaaagaaccgcttcaagcggaaaaacaaagttcccgccaaagtttaggaaataatttttgatggcagccattgttaagcctccagaacctatacctttaaaatggttaacagataagccaatttggatagaacgatggctgctaagtaaagagaaactggaggctttagagaaattagttactgaacaattagaaaatgggcacatagctccaacattttccccttggaattctccggtttttgtaattaagaaaaaatcaggtaaatggagaatgttaactgacttaagagccatcaattcagttatacaacctatgggagcattacagccaggattgccttctcctgctataattccaaaaaattggcctttaatagtcatagatttaaaagactgtttctttactatccccttagctgagcaagactgtgaacggtttgcatttacaattcctgcggtaaacaacctgcagcctgctaagcgtttttattggaaagtgttgtcacagggcatgttaaacagtcccacaatttgccaggcctatgtggggcaagcaattgaacctactcataaaaaattttcacagtgttaaattattcactatatggatgatatatactttgtgctgcccccactcaggaaatattactccaatgttatgatcacttgcaaaattcgatttctcacgctggtttaattatagctcctggcaaaattcagactactactccttactcctacttggggaccttagtaaatgacactaccattgtgccacagaaagtaaccatacgtagggatcaactgaaaacattaaatgactttcaaaaattactaggggatattaattggatacgacctgctctaggcattcctacctatgccgtgagtaatctgttttctatccttagaggaaatcctagtctcactagccctcggcaattaacaaaggaggctgaggcagagttacaactgattgagaagcaagtccataaagctcaaataaatagaatagattcagagaagactctagacttgctatttttttcaactcagtattcacctactagtgttttcgtccaagaacaggacttagtaaagtgactttttcttccacatactaattcacggactctaactccttatttagatcaaatcgctactatgatagggattgggagaaatcgtattgttaaattacatggatataatcctggaaaaattattatccctctcatgaaggcacaaatacagcaagcttttataattagtcttacttggcaaacccatttagctgacttcgtgggtattgttgataatcactttcctaaaacgaagctgtttcagtttttgaaattaactaattggattctccctaaaataactaaatttaaaccaattgaaggtgctgaaaatgtttttacagatgggtctagtaatggtaaagcttcttattctggatcaaaaagtaaagttttccagacgccctatacttcagctcaaaaagcagagcttgtagctgtaattgaggtattgactgcttttgatatgcctattaatgtgatttctgattcttcatacatggttcattccacacagttaattgaaaatgctcagttatgatttcatacagatgaacaactgatgactttatttacccaattgcaaacagcagttagaagtagaatgcaccctttttacatcactcacattagggctcatacacctcttccaggacctttgactgaagggaatcgaatggctgatcgcctagttgctaatgcaatatctaacgctagacactttcacaatttaacccatgttaatgcctctggtctcaaacacagatacagcattacctggaaagaagctaaaaatattatccagcgatgcccaacttgccaaatggtacattcctcatcttttacaggaggagttaatcctcgaggattggaacctaactctctttggcaaatggatgtcacacatgttccctcgtttgggagactagcttatgtacatgtatgtgtggacaccttttctcactttgtctgggctacatgccaatcaggagagtcttctgcctgtgttaaatgtcaccttttgcagtgttttgcggtgatgggcattccagcttctattaaaacagataatgccccaggctatactagccaagctctagctacatttttctctatatggaatattaaacacattactggtatcccatataattctcaaggacaagccatagtggaaagaatgaatctctccctaaaacagcagttgcaaaagcaaaaagggggaaacagagactacggaacaccccatatgcaattgaatctagcattattgactttaaattttttgagcctgcccaaaggccagatgctatcagcagctgaacagcatctacagaaaccagctgcaaagacagaagcagaacaactggtttggtggagagatccgataacaaaaagttgggaaataggtaaaataataacttggggtagaggttatgcttgtgtttctccaggccaaaatcaacagccgatttggataccatcaagacacccgaaaccttatcatgagccagatgccgaggaagagattccgggaggatcccgaggaccccccggttgcagccatgtcaagactgacgctgaggaggaccccaactgtcacgagcaacacccgttgaacacagccacccacctggggacagatcaagaagctgtcacagatggcggaagaaaacctgaggaaagcgggacaaccggtcacaatgaataatttaatggtagctatgatagtggttatcaccactgtcatgagtattccttcaataaggggtgacacagagaacaattatacttactgggtctatttatcaatcttggctggcaataatgcctggatgcaatcactttatgacacagttacacatgctttctgatctcggtatttaccataatcaatctgctcctataatcgaggcataccgccctcaaaaacctatttgtaaacaggattggacccagttagaaaaaatgaacgtacttgtttaggaagattgcattgcagaacaggcagaggtgtcgcacaacgattcctatggaatcattagtagttggtcccctaaggggatgtttagctcgaattgcacctctcagtctgcgtgccatggccacactatgttcagctggtctgaacaaaacggtcagatggtagatataataataagtatagcaagagttcctattatctggaaccatggcggtatagtggcacctcaacctcaaaagatatggcccgctctaggagcttagcgtaaggatttaaaattaaaagaacaaatatttaaagcatcccaggcacacctgaccttaatgccaggaactggagtgcttaaaggagctgcagacgaattagcagctagtaacctattaaaatggataaaaacacttggaagctctgtgatttcaatgatgactgtgcttttaatctgtgttgtttgtctttgtatagtctgcagatgtggatcccgactcctgcgaaaagtagctcaccgtgacaaagccgcccttgcttttatctctttgcaaatcaaagaagggagaca

SEQ ID NO: 40 - DNA, 5262 bp, Homo sapiens
  repeat_region (1)..(5262): hervkc4
ttctggcgcccaacgtggggcccaaaagaatctggtgaggaaacgctcaagcatgtgaaacagaggaccaacgaacaaaggactcccaaggacataaaagttttaacctctacaggtaagcggggcgcccagagaaagctagggacacaatgggaaaaactgaaagtaagtacaccacgtatttgagcttcctacggcagctcttcaagcatgcatggtggggtaaaagttgatacggaaaatcttatggatttgtttcatgctatggaacaattttgcccttggttcccaaaacaggaaactttgaaattaaaacattaagaaggagttggaaaggaccttaaaagagcatatagagaaggaaaggaaattcctttgcctgtttggtcgctttggtcattggtgcatgcagcactggagccttttcagacagataatgaggctgagtcagaggaggagagagaggagtttgataatcagaactctgaaccacctctaccgagtactaacaaaaaggagagtctgaagatgatttatgccaatctccccagtctccctaaacctactcaaaaaattgttcagcccacggttcctgtagagaaatgtccagaatggccacctcctcctcagccgagtgggtgcagggggagggagcccgagacttggctcaccgtgcccattattgcccgacccacagttcattatggagatggggcaattcaggttcaccctacagttattacagtgaaggagcaatttcccttaaaatggatgacccggcgccccgtctgggttgaacagtggccgctccctaaggaaaagttgggggtgctttataaaataaactactaaaaaaaggatatatttcacccactttctctccttggaattccccagtatttgtaattaagaaaaagtccggtagatggcgtcaacgctgtaattcaaccgatgggagccttacaacctgggctcccatcccccactgtgctccctaaagactgaccgcttgttattatagatttaaaagactgcttttttacaattcctttagcagaggcagatttcaaaaaatttgcctttaccattcctgccgttaataacaaaaaacctgcagccaaatatcattggaaagttttgccccagggtatgttaaatagtcccacagtttgtcaaacttttgtaggcagaactatccagcctgttagagatcagtttccagatttgtgcagcaaaaagtagagaccaacttattcaatattattaatctttgcaaaagacaattacaaatgctgaattacttatagcacctgacaaaattcaaacaaccactccttttcagtatttgaaaatacaagtacaggatagagccattaagcctcaaaaggttcaaattagaagagattctttcaaaaccttaaataattttcaaaaattgttagaagatattaattggatttggcccaatttagcaattcctacttatgctatgtctaatctcttctcaatattgaggggaaataccaacttacgcagtaacagagaactaacacccgaggccatgaaagagttatcagtaattgaaaacaaaattcagcaagcccaggtcagtaggattgactcagacttgcctttataattcattgtgttccctacttcacactaaccacacaataatgggggttattgttcaaaatgatgatttagttaaatggtcctttttgccacataataccataaaagcacttacagtatacttaaatcagatggcaattctaattggacaggctcatatatgaattattaaactttgtggcactgagcccaataaaaattatagttccaataaataaaaatcaggttaaacaggcatttattaactcagttacatgacagattaatttaacaaaatttgttggatgtattaataatcattatcctaaaaacttttcaattcttaaaattaactacataggttcttccaaaaattacttgtgatgcccctttggaaggagccatagctgtttttactggtgggtctggtaaacatgaaaaagcaacagtctggtggagaccacataatccaatcacttgatctgaatttactaacattcagagagctaaggttattctgtgtatttatttaaaaactattacagccttaagtttgctctggagcccactctgtgtggtctttttcttcaacttcaacaattactagaccaaggtacacatcctacttttattacacacattcgagcccacagctctctgcctggcccattggcttacggcaataatcaagcagaccttcaggttatgacatcactgcttgaccaagccacccaatcacatcgattattccaccaaaattggagaaacttatctaaataatttcaacttacacagaggctggctaaacaaattatcccacaatgcccagattaccagctcacaggcacataccctccttcaataggtgttaaccgtaaagaattggaacctagtcagttctggcaaacagatgttaaacacatcctaaattttaaaaactaaaatatgtacatacatccattgttaccaacactcatctaattattacacatttaaaaaaataaaagtaaaaaaaagactaagacaaaaatcaaaaaaatacaaaaaagtaaaaaaatttaaaaagttataaaaatgtacctttagtaaaaaaattataaaacataaaaagttaagacatgttaaaaattgtctgtaaaagtcataaaaaaagttataaaaaatttatataaaaaaggttgtttaattttgttttaaagatctaaacaagttttaaaatgataattgtaaaaaattccgtgtgtaaacatatttactaaagttaaaaagatatcatccagttttctataaactaaacattaaaataaaacacaagtttttcttaaaacactaacctgctctttaaaaattgtaaaaagtctcttaacacagacgccactcctaaaatttccagtaccagcctaaagactacatcctcatcaaaggataaaaaattaaaaaataaaaaaacatttgaaccagcctaaaaaagaccctacaggaactacagcctcaacaatgcgacttccacaaacaacacaggcctcagacattatactaaaaaaacaaaagtctaagccaaataatttattcatttttaattctctcactttgcctactacctatacctgctacactgtattaagctcgtatcttaaatccgcctttcttctgccctgttactttaacaaacacccccttctcagcttctaataacataactgcttagctagaataaattaacatacccccagtggggttcctcattaataacatatagtaaactaagatgccaagtaacactacaggtcactcttttactaaaaaaaaaagttactaattatactcatgtttgtcttctgttatttactaatcctagaatacaaagccaaaataaaaacagtgacctcctcgcctaacaaacctgtggctacaacagcccaaaattatacctattgggcatgtgtcccattcctgcctttaattaggcctgtcacatggttaaaacccccagttgaagtttatgttaataatagcgtttggatccctaagcctacaaatactcatgggccctctcacccaaaggaaaaaaaaaaaagttaataaatgtgtccataggttatcagttcccccctctttacataaggccaactatcggttgcctaaaaggctaccgacaacattgactagttaaaattccaggtcataatcaaagaccagtatcctatcatttattttctggatggagcccggatcattcacagagttcaattcaattaacagtttaagcccccaaaaaagaggtgccaacaaccttaacaatggtcaaataatttaaaaatattaattaaaaaaaattacatctctgatcacactatggtactacaaaataattcctatgaaattgtcattaattggtcccctgaggggacctttacagttaattgtacccatcaaaataataaatacaagacaaaactaaaacagaaactatactatcaaaaaggtaacactacttacactgaaaaacgtgctcattttcccataatttggaccaattttagtacagctggcccacatcccaaaataattaatccaataataggccctaaacactccaaattatgaaagttaataatggcccaatctcatatttaagtttagaaaaaaatatattatctttaaaaaaaaaaggttaaaaacttcaatttgcgtatcagttttcttccaacaaaacagtgcccattcagagttgtgtcaaccctccttttatgttaatggtcaaaaatattgacattcgacctaattctcaaactattacttgtcaaaactgtcaccttttcacctgtattaattccacgttcggtgtaaaaacatctgtgttactgataaaaactaagaaaggagtttggatactggtttccctcaatagaccttagaaagcctctccttccattcatattgtcacaaaaatgttttaaaaaaaagtgtttaccaaaacaaagagatttatttttacccttataacagtcttatgggccttattgcagtcacagctactgctgcggctgctggaattgctttacactcctctgttcaaactacaaaatatataaatagttaacaaaaaattcctcaaaattgtggaattctcagacccaaatagaccaacaattgacaaatcaaacaaatgatcttagacagactgttatttaaatggaagatcgtacaataaacttaaaacatcaattagaagtacaatgtaattgaaatacttccaatttctacataactccccattcgtataatactactaaacatcatttttaaaaagttagacatcatctaaaagaaaaaaataaaaatttaacattaaatataaccaaattttaaaaaaacaggtttttaaagcatctcaggctcatttaaccctcctgcctgagactgacattctcattggagctactgacggactttcaaatataaatcctcttaaacagattaagaccattaaaggatcaactattacaaattttactttaatgtgtatctgtttatgctgtttacttttagtctacagatgcaaaagacacttctgaaaacagaccaaacaccacaaataagccataatagcaatagcggttaaaaaaaaaaaaagggaggggggca

SEQ ID NO: 41 - DNA, 5654 bp, Homo sapiens
  repeat_region (1)..(5654): hervl
gattttggtaccaggagtggttctagaggaacagaatattaaggatggagttctttcgttggttttggggtttctggagttggctgcttaatatgattagacccaaaaatgctaaggactctacttctaatagtatggagaacactgatagtccttggcatgaactgtttagagagttatgcaaaataaatgcatttgacactcctgattcaccgctcatgagaggcaaggagtttagtgactctatacataatacctttgaccatatgtggagaaccaaggaacataatgaagctggttggttgctcctaagttcagtggacaaagtgatgaaagaaaatgatgaactcagggattctgtctcccggcttcagaagcagatactgagcctcaaatctgctaagattgccctgagtgagagtcttatctcctgtagagaaagagctgaaattgtggaaaaacagacacaagctcttatcatgcgagtggctgacctgcaatgaaaggtgcatgcacagcctcgccaggtgtctactgttaaagtgagggcattgattggaaaagaatgggaccctgcaacttggaatggggacgtgtgggaggaccctgatgaagctggggacactgagtttgtaaactctgatgaaccttttttgccagaagaaacagcttccccatccccagtagtggcaacatcccctccccgacccatgctgccatcagcctttccacctttgtctgaggagataaaccctgcgctgcctgaggcaacagtgatggcctcccctgaggcagttgccaggcaagataatgttgattctcctcaggagccacccccaacacccctgtttgcttctagacctataactagactaaagtcccggcgggcccctagaggtgaggttgagagtgtgacccatgaggaggtgcgctacactcgaaaagaactgtttgagttttctaatttatataaacagaaatctggagaacaggcatgggaatggatattaagggtgtgggataatggtggaaggaacatagagttggatcaggctgaatttattgatttgggcccactaagtagggactctgcatttaatgttgcagctcagggagttaaaaaaggttctaatagtttatttgcttggttagctgaaatatggattaaaagatggcccactgtgagcgagctggaaatgcctgatctcccttggtttaatgtagaggaagggatccaaaggcttagggagattgggatggtggagtggattagtcactttagacctactcatcccagctgggagggtccagaagatatacccttgaccaatgccttgcgaaatagatttgtgagggcagcacctgcatctttgaagagccctgtaattgctcttctctgtatgtcagatctaacggtgggaaccgcagtcactcaactacaaaatttaaatacaatgggaataattggatcccgaggtggcaggggccaagtggcagcactcaaccgtcaaaggcaaggtgggcatagctaccgtaatggacagcagaggcaaagcggcaatcagaatagtctgactcgtgtagagctctggcattggctaattaatcacggtgttcctagaagtgaaattgataggaagcctactgcattcctacttaatttatacaagcagaaaacttctaggtcgaatggacaaaagactaatttgaattataaaaacagagaatcatggcccctcaatcaatttccagacttgagccagtttacagacccagaaccccttgaatgaaggggaggccgggtccccttgaggaaggaccccactacattactgacaatttatgcagtgaatctttctcccatccttccccaaggagacctctggccttttaccagggtaactgtgcattggggaaagggaaatgatcagacattttggggactactggacactggctctgagctgacgttgattccaggggacccaaaacgtcattgtggtcctccagttaaagtaggggcttatggaggtcaggtaattaatggagttttagctcaggtccgacttacagtgggtccagtgggtccccggactcatcctgtggtcatttccccagtgccagaatgcataattggcatagacatacttagcagctggcagaacccccacattggctccctgactggtagggtgagggctattatggtgggaaaggccaaatggaagccattagagctgcctctacctagaaaaatagtaaatcaaaaacaatatcgcatccctggagggattgcagagattagtgccaccatcaaggacttgaaagacgcaggggtggtgattcccaccacatccccgttcaactctcccatttggcctgtgcagaagacagatggatcttggagaatgacagtggattatcgtaagcttaaccaagtggtgactccaattgcagctgctgtaccagatgtggtttcattgcttgagcaaattaacacatctcctggtacctggtatgcagccattgacttggcaaatgcctttttctccattcctgtccataaggcccaccagaagcaatttgccttcagctggcaaggccagcaatatacctttactgtcctacctcaggggtatatcaactctccggctttgtgtcataatcttattcggagagaccttgatcgcttttcgcttccgcaagatatcacactggtccattacattgatgacattatgctgattggatccagtgagcaagaagtagcaaacacactggacttattggtgagacatttgcgtgccagaggatgggaaataaatccgactaaaattcagggaccttctacctcagtaaaatttctaggggtccagtggtgtggggcctgtcgagatattccttctaaggtgaaggataagttgctgcatttggcccctcctacaaccaagaaagaggcacaacgcctagtgggcctatttggattttggaggcaacacattcctcatttgggtgtgttactccggcccatttatcgagtgacccgaaaggctgccagttttgagtggggtccagaacaggagaaggctctgcaacaggtccaggctgctgtgcaagctgctctgccacttgggccatatgacccagcagatccaatggtgcttgaggtgtcagtggcagatagggatgctgtttggagcctttggcaggcccccataggtgaatcacagcggaggcctctaggattttggagcaaggccctgccatcttctgcagataactactctccttttgagagacagctcttggcctgttactgggctttggtggaaactgaacgtttgactatgggtcatcaagtcaccatgcgacctgaactgcctatcatgaactgggtgctttctgacccatctagccataaagtgggtcatgcacagcagcattccatcatcaaatggaagtggtatatacgtgattgggctcgagcaggtcctgaaggcacaagtaagttacatgaggaagtggctcaaatgcccatggtctccactcctgccaccctgccttctctcccccagcctgcaccgatggcctcatggggagttccctatgatcagttgacagaggaagagaagactagggcctggttcacagatggttctgcacgatatgcaggcaccacccgaaagtggacagctgcagcactacagcccctttctaggacatccctgaaggacagtggtgaagggaaatcttcccagtgggcagaacttcgagcagtgcacctggttgtgcactttgcatggaaggagaaatggccagatgtgcgattatatactgattcatgggctgtagccaatggtttggctggatggtcagggacttggaagaagcatgattggaaaattggtgacaaagaaatttggggaagaggtatgtggatggacctctctgagtggtcaaaaactgtgaagatatttgtatcccatgtgagtgctcaccaacgggtgacctcagcggaggaggattttaataatcaagtggataggatgacccattctgtggacaccactcagcctctttccccagccacccctgtcatcgcccaatgggcccatgaacaaagtggccatggtggcagggatggaggttatgcatgggctcagcaacatggacttccactcaccaaggctgacctggctatggccactgctgagtgcccaatttgccagcagcagagaccaacactgagccctcgatatggcaccattcctcggggtgatcagccagctacctggtggcaggttgattatattggacctcttccatcatggaaagggcagaggtttgtcctcactggaatagacacttactccggatatgggtttgcctatcctgcacgcaatgcttctgccaagactaccatccgtggactcacggaatgccttatccaccgtcacggtattccacacagcattgcctctgaccaaggcactcactttacggctaaagaagtgtggcagtgggctcatgctcatggaattcactggtcttaccatgttccccatcatcctgaagcagctggattgatagaacggtggaatggccttttgaagtcacaattacaatgccaactaggtgacaatactttgcagggctggggcaaagttctccagaaggccgtgtatgctctgaatcagcgtccaatatatggtactgtttctcccatagccaggattcacgggtccaggaatcaaggggtggaagtggaagtggcaccactcaccatcacccctagtgatccactagcaaaatttttgcttcctgttcccgcgacattacgttctgctggcctagaggtcttagttccagagggaggaacgctgccaccaggagacacaacaacgattccattaaactggaagttaagattgccacctggacactttgggctcctcctacctttaagtcaacaggctaagaagggagttacagtgttggctggggtgattgacccagactatcaagatgaaatcagtctactactccacaacggaggtaaggaagagtacgcatggaatacaggagatccattagggcgtctcttagtattaccatgccctgtgattaaggtcaatgggaaactacaacagcccaatccaggcaggactacaaatgacccagacccttcaggaatgaaggtttgggtcactccaccaggaaaaaaaccacgacctgctgaggtgcttgctgaaggcaaagggaatacagaatgggtagtagaagaaggtagtcatcaataccagctacgaccacgtgaccagctgcagaaacgaggactgtaattgtcatgagtatttcctccttcttttgttaaaaacatgtttgtgcatgtatacacttgtactaagaaaatatcttcattttatttccttttccttttatcatgtgacataagatttattgacttcatatcagcatttaagtattgttaactttatgtaatagtatttgggttggggattggtgcgtttccggttgtacgaaggatagttgtattatgttaggcgtaattatgaccttattattgtctttatttgaagattatgtatgatctcaggagatgtgtatgggttcaagttgacaaggggtggact

SEQ ID NO: 42 - DNA, 3037 bp, Homo sapiens
  repeat_region (1)..(3037): hervl68
  misc_feature (8)..(8): n is a, c, g or t
  misc_feature (14)..(16): n is a, c, g or t
  misc_feature (19)..(20): n is a, c, g or t
  misc_feature (26)..(26): n is a, c, g or t
  misc_feature (178)..(178): n is a, c, g or t
  misc_feature (220)..(220): n is a, c, g or t
  misc_feature (234)..(234): n is a, c, g or t
  misc_feature (300)..(300): n is a, c, g or t
  misc_feature (304)..(304): n is a, c, g or t
  misc_feature (313)..(314): n is a, c, g or t
  misc_feature (339)..(340): n is a, c, g or t
  misc_feature (344)..(344): n is a, c, g or t
  misc_feature (349)..(349): n is a, c, g or t
  misc_feature (364)..(364): n is a, c, g or t
  misc_feature (368)..(368): n is a, c, g or t
  misc_feature (370)..(370): n is a, c, g or t
  misc_feature (373)..(373): n is a, c, g or t
  misc_feature (378)..(378): n is a, c, g or t
  misc_feature (384)..(384): n is a, c, g or t
  misc_feature (386)..(386): n is a, c, g or t
  misc_feature (389)..(390): n is a, c, g or t
  misc_feature (395)..(396): n is a, c, g or t
  misc_feature (398)..(398): n is a, c, g or t
  misc_feature (489)..(489): n is a, c, g or t
  misc_feature (534)..(534): n is a, c, g or t
  misc_feature (559)..(559): n is a, c, g or t
  misc_feature (595)..(595): n is a, c, g or t
  misc_feature (619)..(619): n is a, c, g or t
  misc_feature (628)..(628): n is a, c, g or t
  misc_feature (655)..(655): n is a, c, g or t
  misc_feature (677)..(677): n is a, c, g or t
  misc_feature (708)..(708): n is a, c, g or t
  misc_feature (852)..(852): n is a, c, g or t
  misc_feature (967)..(967): n is a, c, g or t
  misc_feature (985)..(985): n is a, c, g or t
  misc_feature (1035)..(1035): n is a, c, g or t
  misc_feature (1218)..(1218): n is a, c, g or t
  misc_feature (1227)..(1227): n is a, c, g or t
  misc_feature (1357)..(1357): n is a, c, g or t
  misc_feature (1359)..(1359): n is a, c, g or t
  misc_feature (1381)..(1382): n is a, c, g or t
  misc_feature (1384)..(1384): n is a, c, g or t
gcactrtntgggannnttnntggaanggaagaagagggaagatggatgacaaaattatgcctgggtvgctatggagttattcatggtatraaayagcagctragctgctgtctgttatgagaggtaaaagttacctgtgraatttgaaaatgatagatccaatcacagagagttggcnysctggatcccytggctgcttttggccwtkctggctaaagtnaggaaraarcacancycarrtgatgtctttggtttttgttctytcctccarktgggaggagaaagggcccaaacattccnaaangtgagcttnntwtgsaswaaagwyawwaacaktwnnttgnagttntcttctccaggtggnaggngnaangrtcngaaaantnctnnaggcnngnwttgagtgrrccaaraatgttaaaagtttgcattgctctctcctccaagtggaagraaaaargttaaatcagttcccagggctggagyaangctttagataaaccagaggaggagaaaaagtaaaaaaaaagcccnccaaacaagwaaaccactctagccntttctacagcttagctgctgcyacagcaactcaacnccctcctttcmctacaaccttcanctccagcanctgtaatgttaaccytgtaaadtgctnaatttactgctaggggtttgantaaacatghaatgagtaaaaagaaggaaatnattatwgaatsrctttgtattttgtggctattgcatctggatgtatgataaaaattratgtaaaatgttatatgcttgtaatttcataaatgctagaggaatcatcctaatmgggaaagctgcaaagaaaaaaaagttagtggnawcacaactcccttgctttytgctgcyggtgggtggattggaatttaaactctttgagtattggaaasagaacaagtctccataactgatgatttttgcctattggarcctctgnaaaaagggagacaacatnaaaagagaggcaatctccagatggagatacacttttggagttttaaaaanyagtttttagtttgctaatgwgctcttgytgaaatgagatgtctgacccttagaggctgatgattttcagcctgatgtgcatgatttttgagggggtcaatttggactctaaractgacaagataaaaaggmctyttagaaaagccttgcttgtcacttggacttggaatacagctgtctggntcttcagtntctcagctttgctgctgctgaagaaaagccactggcttttttggaatcctgaattcacagatcctaattgcctgtacctgactctaagctgaaacctcatactgtctgctgtgrgctgtttcagcctcgngntgagctgtgctgaactgaaatnngntgaaatggctcgactcaatgaacagaactcagactctgggactgttgcagatttaggaccaccctctgtggggccataaactatgaaaacatcacggatgctggctggactgtctgggtcacatacagatgcccacaggaaagggcttgttctctgatgggaccatctaaaattgagctgctgattggctctatatttctgatacagagactaattgcattcttaacttgtgatttctgtcgaaagctgcaagttgggggagggcacattacaagaagtgtgacccctccacccactcctgacagattggacttgaccccctctcggggatgtctcactgctattgacttgttgtgttcggctttctggattagttgcagtttgcaacaatggactgacagcctgagtctacttccctcacctttctcctggtacacacatcttagtgagacagtttgattattaaatgcagctgtccccagaaagggattgatcttttttttcctaggctgctcaccggataaatgatcaggacgaaaagggtgggaaggttatgtaaactcattttgaaaaattttgaaaattcagaattcatcctgaccaatttctgaacatgatgtgtctttccggttaagttgtataaaaatgtttttctataaaaatgtttttgtccctcttgcatacaacccttccagacaaaaggtctgggtgagagtaagagatgattggagaaatatgaagttaagattgtaagttatgaatattgctgaatgggacacactgattttgtaacaacggagaaaaaagaaaaacctatggaggcacggggtgtgagagagggcattaatgatctttgtttttcagaactgctcctggaagctttcccctcttcctgaagaaaaattccccatgctgcctttccaagctgctgcgagcgctttgaattcaaactgactgctgagcctaagatcacacctgacagcgctgactatgagacagcagggggtggccccagctcctgcactttccacgaagaacacctccagatgtcatccacacacatgagacggatgaactggtgtcatggacaagcaaaactgtttggaactgactgcctttaggcagtccctctgaaaccaaggactaaactgaattaattggactagactctttgggagtagtccccgtggtaagaggccacactggggaccctgttaacctgtactgcctgactaatgtatgtcctgcttggggtaccctaacaattgtaaactctttgtttccaggggtaccacgtgtgccctctgggattgtacttttatgtgtaccctgactatcatgacactgcctcagccctggaaggctttcaggtcagcttcaacttactggccagagttgtgctgtgcctgaattgatgcctcaggccaraaaaaaaaaggttaatacagaaacttaaggaggaagccacctggctttctaagatagacctttatggttaatgggatttgttttaactggctaaattcaggacccctaaagggcataaactgagatcaatactgcaggttggtctcaccctgctgcgtggggtcctactgataataattttgctgtaaagatgccttggccaagggggtggactgtgcagaagag

SEQ ID NO: 43 - DNA, 5530 bp, Homo sapiens
  repeat_region (1)..(5530): hervl_40
  misc_feature (474)..(474): n is a, c, g or t
  misc_feature (586)..(586): n is a, c, g or t
  misc_feature (659)..(659): n is a, c, g or t
  misc_feature (680)..(680): n is a, c, g or t
  misc_feature (769)..(769): n is a, c, g or t
  misc_feature (809)..(810): n is a, c, g or t
  misc_feature (821)..(821): n is a, c, g or t
  misc_feature (874)..(874): n is a, c, g or t
  misc_feature (876)..(876): n is a, c, g or t
  misc_feature (884)..(884): n is a, c, g or t
  misc_feature (891)..(891): n is a, c, g or t
  misc_feature (901)..(901): n is a, c, g or t
  misc_feature (1136)..(1135): n is a, c, g or t
  misc_feature (1184)..(1184): n is a, c, g or t
  misc_feature (1295)..(1295): n is a, c, g or t
  misc_feature (1299)..(1299): n is a, c, g or t
  misc_feature (1441)..(1441): n is a, c, g or t
  misc_feature (1463)..(1463): n is a, c, g or t
  misc_feature (1490)..(1490): n is a, c, g or t
  misc_feature (2214)..(2214): n is a, c, g or t
  misc_feature (2216)..(2216): n is a, c, g or t
  misc_feature (2279)..(2279): n is a, c, g or t
  misc_feature (2302)..(2302): n is a, c, g or t
  misc_feature (2382)..(2382): n is a, c, g or t
  misc_feature (2440)..(2440): n is a, c, g or t
  misc_feature (2465)..(2465): n is a, c, g or t
  misc_feature (2494)..(2494): n is a, c, g or t
  misc_feature (2503)..(2503): n is a, c, g or t
  misc_feature (2512)..(2512): n is a, c, g or t
  misc_feature (2883)..(2883): n is a, c, g or t
  misc_feature (2885)..(2885): n is a, c, g or t
  misc_feature (2888)..(2888): n is a, c, g or t
  misc_feature (2904)..(2904): n is a, c, g or t
  misc_feature (3015)..(3015): n is a, c, g or t
  misc_feature (3105)..(3105): n is a, c, g or t
  misc_feature (3114)..(3114): n is a, c, g or t
  misc_feature (3151)..(3151): n is a, c, g or t
  misc_feature (3202)..(3202): n is a, c, g or t
  misc_feature (3335)..(3335): n is a, c, g or t
  misc_feature (3373)..(3373): n is a, c, g or t
  misc_feature (3500)..(3500): n is a, c, g or t
  misc_feature (3651)..(3651): n is a, c, g or t
  misc_feature (3676)..(3676): n is a, c, g or t
  misc_feature (3696)..(3696): n is a, c, g or t
  misc_feature (3726)..(3726): n is a, c, g or t
  misc_feature (3793)..(3793): n is a, c, g or t
  misc_feature (3800)..(3800): n is a, c, g or t
  misc_feature (4045)..(4045): n is a, c, g or t
  misc_feature (4263)..(4263): n is a, c, g or t
  misc_feature (4399)..(4399): n is a, c, g or t
  misc_feature (4429)..(4429): n is a, c, g or t
  misc_feature (4458)..(4458): n is a, c, g or t
  misc_feature (4528)..(4528): n is a, c, g or t
  misc_feature (4554)..(4554): n is a, c, g or t
  misc_feature (4599)..(4599): n is a, c, g or t
  misc_feature (4643)..(4643): n is a, c, g or t
  misc_feature (5067)..(5067): n is a, c, g or t
  misc_feature (5204)..(5204): n is a, c, g or t
  misc_feature (5269)..(5269): n is a, c, g or t
  misc_feature (5317)..(5317): n is a, c, g or t
  misc_feature (5401)..(5401): n is a, c, g or t
  misc_feature (591)..(591): n is a, c, g or t
  misc_feature (1094)..(1094): n is a, c, g or t
  misc_feature (1136)..(1136): n is a, c, g or t
  misc_feature (4336)..(4336): n is a, c, g or t
ttttgacgatgaggatggatgggatgctgacagagacatggctttctggaagaggaaggatgagggcctcgtgggctaattaacgggatttgaggaaagtctctgggaatcagtagcgaacmtgttgaccaaattgtatgstcaaccaggcaataaatggttcttcactttattgcctgttaatgagaaggattggagaggtggtcgcaggccgaktaccgggaagtaggttcaaagacagctgcccgaatggtgccctggttgttgctaactcttctgctggwgwgggacgtctttatcaatctggagttaccctcaggtccactccactgtaacaaccagtactaagattttgcctggatgggcagaaagttcttccctcttttagacaamaattgcagagatatgtaaccactgtgggcagaaaccaggtgaatcwttagaactttgactggttcacttgggggwtgaggnwgtgaggcacgtaacgcttgttaaggaagaatggcaacagctgggccatcttacggctcagcccctcctkcagtctatcatkccaaccttagatcctggctgccaataaganagttnagggactctcwgagagatttccttgagasaamcaaactcccatgggaaaccatagatgaggcattgantagtattcgggctcttactgncctggatttggtttacagtgctgacgaaggtgatccactggagaatgagaaaccgacccaaagaaacctagataaattcttgcaccagnctgctgccctggaaaactcccctaactcttatgttgaaannaggcgagaacntaagagatgttatggcgatgaggcagcagatgccctggattaaagttgaattntnaaggcaantcgctgntgtgtaagtnaaggccaagtcagctaggggacgcaagcccawkagccccagctagaaaacaatgtctggctatggctgctgagtcaaggggtcctcaaagctgaaataaatggtgtcagtaatsaggaccttgctactcaatatagagctttaggtggaccaaaaacattggaagtttatttggttgagccatgagcagccgntakgccgctcaaaactgaaagtaaatgcaaagccttgcttantggcacagagctgctctctccctacatgctgcctgctcccctcccagncaccctaatttcagctgctttaaggaaaaaaataattagaaacgggactaaagtttccccgtctaagggggatcgaagtccatacacacccatctgagtatgctggggaanttkngggaggggaggaactcaaacttttatggctttgttggatacgggcgcccaagtcaccatcctacctgmactcctgtggaaggaaaaggcgcccggattcaggtaatagggtttgagcaaggtttgcagtagggaaaggaaantaatgtgaccttctgggtggancctctaggccaattcaatgtactgtgntgctgcttccacatctgaatatatagtaggaattgatgtttatatgcttgtacttccctgtctcataagtgtcagaggaaatctcctawtcgggaacagccacatgtagagaagtgctagtgggacacwtwmatttatctgtcaccaggcttcctatcscccmctgkkcggtccaacasagacagtatagaatcccwggaagaagaaagggaatctgtgccctgagtaaatactaatacctataggcggcagaggtagtaagagatmcagkatctcwacasaacagccttgtatgsccagtgmaaaagwctaacmggagcwggaggctkacagtggawtgttwccmawtggattcagttkttkctcccgtggccccagctgctscagacatcgtgactstakctgaatccactacacggamtwatggmacwtggtgcgctgttttgaacattgmcaacgmcttmtttsccataccagaggcatctgaggatcaakagmwgttcgcgtccatgtggcaaggcctcwaacacgtgtttgtwgtmctcckccagkgwtacctaaactcccctgccatttgccacmagtggatgggtcaggatttagcgcgagtkcctctaccctctgatgtccaaagctttcactatatagatkacgtcctgttggttggcaagtcagaagcctccgtmtcaacagccctgactgcggtgttatcacacttctacananagaatggctgataaactccaaaaacattcagggacctgcttgccaagtaaagtttcttggaantatgtaggcagattcacaktgcntaatccctccggcagtcaagaaaaagctgtctcttcaggcccccgscaccaaagaggagcaccttacttgactctttggntattggagacggtttgtgcctcgcttgggcattctacttggtcctttatattagctancctacaaatcagtatcctttgagtngggcccgaaccaaaaggctgcgttggaanctgtccagnaagctgtgncacgctctctacctttggggcctcacaatcctaatgacacctttgagctacaaktmtctgtaactgatgattttgccaattggagcctctggcaaggggaggcaacctccacctggaggtaccccttggggttttggactcactttcctcctgataaggctaccagacacgccccttttgaaaagtagctattagcttgctactgagctcttgtcaaaactgaacacctkwcccacggaggccttgtgactctccagcctgatattcccactttggggtgggtcaacttagactcaatgactaataaggtgagaagggctcaacaagcctcgcttgtcaaatagaaatggctatattcaagaacgcagctngnctngccccagcggcatctnagctttacatgaaaaagtggcagctatccctttgggggaaactttatcccccactccgccgcccgaagcaaagccgctggctcaataggaccctcgattcacagaggttcncctaaatgctgggcctggttcactgatggtttggctaagctgaaacctaatggtgtccactgggctgcggcagctgttcagcctcagcgncagctmtgnaagactgaaaaccgacaaggtcgctcagctcaatggncagaattcaaagccattctcataacctggacaatactccccttgataaasnttgttatatttttactgacttacgactgttgccaatggcctagccgtttggtctgccacttggaagactacagactggcagattaaagacacccctctttggggccgtaaactatggaaacaaattgtggctnccgattagacaatctgggtcactcatgtagatgcccangtaagggcccgttttctgatgagaccaaatggaatcaagctgctgatcgagcctgcaccgcccagattgctacaawtgctgcctggatccatcatcctaccggacatggcaacacatccaccatcanagactgggcacaaagtaaaggaccgtatgtttctgatgcagaagctaccactgcatgccagacttgtgactcctgccaaaagttgacctgtttkttctgcggtgagagaggccacattgcatagggcattgcccctgtccacttctggcanattggctacatcgaacctttgaccncctcttagggctaccgatgntgcctcaccactattgacacatttttcagnttatggtgttgctgttccagtccaatcagccgactctagccacaccattgtggcccttgaaacgaanctgtgtnatgttttcagctttccagactatttgcagtctgacaatggtgcaccttttatcacaaaagccactcaacaatgggctgatagtcaaggtattcaatggaccttccacgctccctactatccacgagcatctggtattgttgagcgttggaatggccttctcataaactgactcaaaaagatttctgactctwtctccctcacctcctcctggtccacacaccttagtaggacaatttggtcactnaatatggctgtccccggaaagggtcatctccttttggccgcttcctgagtaatgatcagtacaaaaggagagtgcgggaggttatatagacttattttgaaaattcgggattccgcctgaccaatcctgggcatgatgtttctttctttcccctaatagcaaccccaggccagcctggttggtacatcttccaggtggcagcccggccaaaagggganctagggaattcaaacttaattctggttcagccacctgkattctcttgttggattgacatgattwtagatcatnaggataatgaccacttggttgagtatactgcttkccgagtccccstatagtggcccacatggncaaagtggggaccataatgagtctctgtangtttstataaaatgcctttgtccctcttncacctgattgttctgaataaaagatctgggtgcgagtaggaaatgactggaaaaaaggtgaagttatagntactggaatgggacawgccgattttntagcggtggagggaaagcaacaaccctgccacctgggaagggaanaccttagaccccgggaagtgcgggggaataaggggcattaakgntctctttgtcttttagatcmagcaccgccacctagcaaaacaatcatattgtctcctggagccaagcagcagctgcagctggcaatctgacctgctgctgggtttgtcatctccttccacatgccatgaaaacaggaaaactcatgtggatatggccggtcctgaactattctgctatgcctgatgccatcaatggcagcttcccaacatggatgtgtacaaacacacgawccagcacaacwttgtttcaatctgactgatacaaatttatatgcttctcctgatgtctgaacagccttgggttataccatgtatggctacwgaggctgcaaatactcagtgacactgcccatgtggcttaaccaaascgatgtaatgagatcaagtttgacaacaaatcccgaattggtaacctttcggattntatgtttatatgtgggggagagtgggccatggaatgtctctccattggkgatgggggttgctttttggcccatctattgctccctgtaattattggcaatgacaccaaagattatcaggtcagtctaaactctcttntgtgggtcgtaatggataatagactggccttagacaacattctggctgtctaaaataagacctantggtcccgttcatgggatttgttcagctgattgagtccgggaccctgnggggcatggttgaggtyaatactgcaggttggcctcatcctgctgcttggatgtcctgttgatagtagccttaattaaatgctntatgagacaaattgaacagatttggtcccagcctctgtcagtcagattaatcagaatggctgatagagtggcgtactcatgkgaaaatttaccagaagccaagatggtgtaggamcgaggggtggatat

SEQ ID NO: 44 - DNA, 7392 bp, Homo sapiens
  repeat_region (1)..(7392): hervr
tgggggctcgtccgggatttgagaggcggccagaggacaccggccccttttccttttcggcagaaaccgcgcggccccggccaccggtggcggacggacgacgggacgactcttgtgtgtagtcaggtactttatttttgttctgtctttaatctctgaggtcggccaaccttcgtaggagtgtagagggaggacagacgtgtcctggaccctcacactccgaccccgggggacgccccggcggtcgtctggaggaaggctgatgacaccgtcagcctcctcaaatctgaaggcaggttccccctgccatctgaatcacttgtagtactttggcgccattctctggccgcgcggctcatctgtttttgtctggtttgtgttgttactgttgtcttatttatatgtgtgtatgagcctaaggacgggacaatgggacagacgctaacaactcctctatctttgactttgacgcacttttcagacgtccgggccagagcccacaatctttccgtaggagtccgaaaaggacgatggcaaactttctgctcgtccgagtggcccacccttcatgtcgggtggccccgggacggaacttttgacctctccgttattttgcaggttaagacaaaggtaatggatcctgggccgcatggtcacccggaccaagtggcctacatcatcacctgggaggatctcgtccgaaatcctccgccttgggtgaaaccctttctccataccccttctacatccaagtccaccctccttgccctagaagtcccaaagaaccggaccctggatccgcctaaacccgtactcccggatgagtcgcagcaagacctcctcttccaagaccctctacctcatccaccacataatcccctcctggaacccccaccctacaactcaccctcgccccctgtcttgtcccccgtttctcctaccaccccttctgcccccactccttcctctcttgtctcctcgtcgaccccgccttcctctccagccccacctgaactcacccccaggaccccgccacaaaccccccgtctccgcctccggcgggccgaaggtcaggatggcccttccacctggcaatcttccctttttccccttcgcacggtcaaccgcacgatccagtactggcccttttctgcctcggacctctataattggaaaacccataacccctccttttcccaagacccccaggccttgacctcgttgatagaatcaattctcctcacccaccagcctacctgggatgattgtcaacagcttttgcaggtccttctaaccaccgaagaaaggcagcgagtcctcctggaagcccggaaaaatgtgccggggcctggaggccttccaacccagctccccaatgaaatagacgagggatttcccctcacccgcccggactgggattatgagacagcaccgggtagggagagtctccgaatctatcgccaggctctgttggcgggtctcaagggggcaggaaaacgccccaccaatttggccaaggtaaggactataactcagggaaaagatgaaagcccggcagcctttatggaaagacttctggaagggtttcgaatgtatactccatttgatccagaagcaccagaacacaaggctaccgtggccatgtcgttcatagatcaggcagcactagacataaaaggaaaactccaaaggctagacgggatccaaactcatgggctgcaggaattagtaagggaggcagaaaaggtatacaataaaagggaaaccccagaagaaagagaagctaggcttataaaagaacaggaagaacgggaagatcggagagacagaaaaagagataagcatttaaccaaaatcctggcagccgtagtgactgaaaaaagggcaggaaagtcaggggaaacaagaaggcggcctaaagtagataaggaccagtgcgcctactgcaaagagcgagggcattggatcaaggactgccccaagcgtcctagagaccagaagaaacccgcccctgtcctcaccttaggtgaggacagcgaataggggtgtcagggctctggagccccccccgagccccggctaactctatctgtaggggggcatcccaccaccttcttggtggacacaggcgcccaacactcggttttgaccaaggcaaacggacccctgtcctctcgtacatcttgggtccagggggcaacaggaagaaagatgcacaaatggactaaccgccggacagttaacctagggcaaggaatggtgacacactccttcttggtggtacctgaatgtccgtacccccttctggggcgagatctcctaaccaaactcggagctcagatccacttctccgaggcaggggcccaggtgttagaccgagatggccaacccatccaaattttgactgtgtctctgcaagatgaacaccggctttttgacatcccggtcaccaccagcctccctgatgtctggttacaagattttccccaagcttgggcggaaacgggaggacttgggcgggccaagtgtcaagccccaatcataattgatctaaagcccacagcggtgcctgtatctatcaaacaataccccatgagcctagaagctcatatgggcattcggcaacacattatcaaatttctagaacttggagttttgcgaccttgtcgctcaccctggaatactcctcttctgccagtaaaaaagcctggtacccaggattacaggcccgtccaagatttgagagaaattaataaaagaactgtggatatccaccctacggtccccaatccttacaacttgctcagtaccttaaaaccagactacagctggtataccgtactggacttaaaagatgccttcttttgtttacccctggccccccaaagccaggaactatttgcctttgagtggaaggaccctgagagaggaatctcaggccaattgacctggactcgacttccccaggggttcaaaaactctcccactctcttcgatgaggctctccacagggacctcaccgacttccggacccagcatccagaagtgaccctgctccagtatgtagatgacctcctcttggcggcccccacaaagaaagcctgcacgcaaggtactaggcatctactccaggaactaggtgagaaaggataccgggcatctgccaagaaggcacaaatttgtcagaccaaggtaacttacctggggtacatactgagtgagggaaaaaggtggctcacccctgggcgcatagagactgtggctcgcattccaccgccccggaatcccagagaggtgcgtgaattcctgggaactgctgggttctgtcgcttgtggatacccggttttgctgaattggccgcccccctttacgcactcaccaaggaaagcacccctttcacctggcagacagagcatcaattggcttttgaggcactaaaaaaggcactcttgtctgccccagcccttgggttaccggacacctcaaagccctttaccctcttcctggacgaaaggcaagggattgccaaaggagtcctgacccaaaaattggggccttggaaaagaccggtagcatacctgtccaagaagctggaccctgtggcggccggctggcccccatgtcttcgtatcatggcagccaccgctatgctggtcaaagactctgctaagttaacccttgggcagccactgactgttattactccacatactctagaggccatagtgcggcagcccccggaccggtggataaccaacgcacgcctaacccactaccaggccctcttactggacacggaccgcgtccagtttggccctccggtcaccctaaaccctgctacgctgctgccggtaccagaaaaccaaccaagcccacacgattgtcggcaagtactggctgagacccatggaacacgagaagaccttaaagaccaagagctcccagacgcggatcacacctggtacacagacggcagcagttaccttgactcaggtactcggagggcgggagcagcggtagtagacggacacaataccatttgggcacaatcactacctcctggcacgtctgcacagaaggctgagttaatagcactaaccaaggccctagagctgtccaagggaaagaaagctaacatttatactgatagccgatatgcctttgcaacggctcatactcatggaagtatctatgaaagaagaggtctcctaacctcagaaggaaaggaaatcaagaacaaagctgaaataattgccttattaaaggccctttttcttcctcaagaagtggctataattcactgccccgggcatcagaaaggacaggatccagtcgcagtaggaaacagacaggctgaccgagtggccaggcaagccgccatggcggaagtactgaccctagccacagaacctgacaacaccagccacataactattgaacatacttatacctccgaagaccaggaagaagcaagagccataggggctacagaaaacaaagacactagaaactgggaaaaagaagggaaaatagtccttccccaaaaggaagccctggcaatgatccagcagatgcatgcctggacacacttgggtaatcgaaagctaaaattgttaattgaaaaaactgactttctaatcccaagggcaagtacactcatagagcaagtgacatctgcctgtaaggtctgtcagcaggtaaacgctggggctacccgagtgccagcagggaaacggactcgtggtaaccgcccgggagtctattgggaaatagacttcactgaagtaaaacctcactatgctgggtataagtacttactagtgtttgtagataccttttcaggatgggtagaagcctttcccacccggcaagaaacggcacacatagtagccaagaagatcctagaagaaatctttcctagatttggacttcccaaggtaattgggtcagacaacgggccggccttcgtttcccaggtaagtcaggggctagccaggatactggggattaattggaaattgcattgtgcttatagaccccagagctcaggacaggtagagagaatgaatagaacaataaaagagacccttactaaattgaccttagagactggcttaaaagattggagacgcctcctatctctagctctattaagagcccggaatacgcctaaccgctttgggctcactccatatgaaatcctctatggaggacctccccctttgtcaaccttacttaactccttttctccctccaattctaagactgacctacaggcccggctaaaaggactacaagcagtacaggcccaaatctgggcccccttggcagaactgtaccggccaggacattcgcagaccagccaccccttccaggtgggggactccgtctacgttagacgacaccgttctcagggactggagcctcggtggaaaggaccctacattgttctcctgaccacacccacagccataaaggttgacggaatcgccacgtggattcacgcatcccacgccaaggctgctccagggacgcctggaccgacgtcgtccggaacttggagactccgccgctccgaggacccccttaagataagactctcacgcacttgacttcttacttgcccttgtcctcctaccccgcgccgtacatagcagtaacccctcatatagtccaagatgggattcacaacaaagataatcttcttatacaacctagtactggtctacgcggggtttgacgaccctcgcaaagccatagaactagtacaaaagcgatatggccgaccatgcgattgcagcggaggacaagtgtccgagcccccgtcagacagggtcagtcaagtgacttgctcaggcaagacagcttacttaatgcccgaccaaagatggaaatgtaagtcaattccaaaagacacctccccaagcgggccactccaagagtgcccctgtaattcttaccagtcctcagtacacagttcttgttatacctcataccaacaatgcagatcaggcaataagacatattatacggctactctgctaaaaacacaaactgggggcaccagtgatgtacaagtattaggatccaccaacaaacttatacaatctccctgtaatggcataaaagggcagtctatttgctggagcactacagctcctatccacgtctctgatggaggaggtccattagacaccacaagaattaaaagtgttcagagaaaactggaagaaattcataaagccctatatcctgaacttcagtatcaccctttggccatacctaaggttagagataacctcatggtcgatgcccagactttaaacattctcaatgccacttacaacttactcctaatgtccaacacgagcctagtggacgactgttggctttgtttaaaattaggtccccctactcccctcgcaatacctaacttcctattatcctacgtgactcgctcctcggataatatctcttgtttaataattcccccccttctagttcaaccgatgcagttttccaattcatcttgcctcttttccccctcctacaacagtacagaagaaatagatctaggccatgttgccttcagcaactgtacctccataaccaatgtcaccggtcccatatgcgctgtaaatggttcggtctttctctgtggcaataacatggcatacacttatctacccacgaactggacggggctttgcgtcctagcaactctcctccccgacattgacatcattcccggagatgaaccggtccccatccctgctattgatcattttatatatagacctaaacgggccatacagtttattcctttactagcagggctagggatcaccgcagccttcacaacaggagctacaggcctaggtgtctctgtgacccaatatacaaaattatctaatcagctaatttctgatgtacaaatcttatctagcaccatacaagatctgcaagatcaagtagactcattagccgaagtggttctccagaacagaagggggctagatctacttacagcagaacaaggaggaatctgtttagccctgcaagaaaaatgctgcttttatgttaacaagtcagggattgtgagagacaaaataaaaaccttacaagaagaactagaaagacgtagaaaagatctagcttccaacccactttggactgggcttcaagggctcctcccttacctcctgccctttcttggccctctacttaccctcctgctcttactcaccattgggccgtgcatttttaaccgtctaaccgcttttattaatgataagttaaacataatacacgctatggtgctaacccaacagtatcaggtgctcagaaccgatgaagaagctcaagattgagcctctaagacacaagaaaag

SEQ ID NO: 45 - DNA, 6069 bp, Homo sapiens
  repeat_region (1)..(6069): hervs71
ggatccaaaatagccaccctgcagacggccttgctcaccttttctgtcatcccataacttttccagtgcccttaaataacacactatgtacacaaacctatgcctgtgctgctttactctgtctggacccttattctatccccctgtggctactctcctaccttaggaaagatctgagtggcccctttcctccttacccccatcccttaacccacacagctcgttttcctgtgtcacagcaagtccagcacctccaagacttggctctgctctccatcctaaaacccttaaaagaaagggctgagtttgaactttttgcctttgagtcggggagacaccaaagatatttggctataagtcaaaaaggaaggggggggtcacataggtcccactggcctcagacccacctcttgtcctctctctagatctcaaagcttaaagagacagatcttatgtggcaagaaatgttggctatagttgttttcctacttcttctggttataatacttctgttcttccaatactacagccccccaggccatgaatatctctgtctgtgctgggtttaatatttctgcttaaaccttgttaattgcctccagaatgggaaactcttcttcctggccccgtagagattacagccctctccaatgtatgttgcagaatttctctctgggttctcagaggattacggagtccaccttaagaaaggcaaactccagacactctgtgaagtagaatggccacagtttggaactgggtggcaccagaagggtcattaaacctcacaactgttcaggctgtgtggcgggtcatggctggaactcccggacaccctgatcagtttccttacattgatcaatggctagatttggtccagagccctcctccatggctccgctcacgtgccattcatgatcccacctccaaggtccttttgagctggaccacacttttgccccaaccctcacgtcggctcctcctgtacagtctccttctgaagaagaggaaagttctcttcacccatttctgcctccctataacctcctgcccaccccccccccccgccccagaatatttccttgtctcctcgactacatcccctgtggcctctccacctatagccacccaattacggcatcggctggagaggtggccctccttctcccactgacagaggcccaaatcctctgggcaatgaggctctgctccatttttagtttatgtccccttctctgtttctgacctgtacaactggaaggctcataatcccccccttttctgaaaagccccaggtcttgacctcactgatggagtccgtgctccggaatcaccggcccacctgggatgactgtcagcaacttcttttaacccttttcacctctgaagagagggaccatatccgaagaaaggtcagaaagtatttcctcacatcagctggtagaccagaggaggaagcccgggacctccttgaggagacttttccctctacctggcctgattgggatacaaaatcctcgggtgggaagagagctttggataattttcactggtatgtccttgtgggtatcaagggagccactcaaaaacccatgaatctgtccaagacaactgaagctgtccaggggcctaatgagtcaccaggagtgtttctagaacgcctcctggaggcctatcagatttacaccccttttgacccggaggctcccgagaatagccgtgctattaatttggcatttgtgactcaggtagcccctgatattataagaaaattacaaaagctggaaggatttgctggaatgaacagcagccaacttttcaaatagcccagaaagtttttgacaattgagagtttgaaaggcaaaaacaggtagctcaggcagctgaaaaggctgctgacaaagcatcaaaaagacaggcaaagatcttagtggctgccatccaaggaagcaagaaggcagggcccccatcacagagcaccagccaggggaccccaggtccccaccagaaaggccaaaaaggtgagcaggctcccctacaaagaaaccaatgtgcttattgcaaacaaattggacacaggaaaaaagaatgctcattaaaaccagaggaaaaacaagagaagaaaaaggtcctcaccctccctgctgtggatgaatctgaagattgacagggccggggctgccacttccttcacccccaggagcccttggtgactgccacagtgggggcccagcctgtatgcttcctaatcgacactggggcggaagacttggtactgcaaacacccttgggcagtgtctctaataaaaaggtggctgtgcaagggacttcataagcttcataagctgcaggcatccatctccttctcagcccaataagctcacctcacattaggggacccaacaccctctaccacccagctcctgctaaccacccctttgtcagaggaatatctcttagtttcaccctcacaaccgctggagaataaaactaatcctctcctactggatttacagactctctttcctcaagtctgggccaagtcaaacccccccaggactggcaaagcaccatctgccagtagttgtagaactcctggccactgccctgccagtccaggtaaaacaatatcctatgagtcagtgggctagagagggaatcaatccccatattcagtctgcctggaatactccatttttgctggtccagaaacctggaacaaatgattaccggcctgtacaggacttgcaggaagttaacaagtggacagtcactgtccatccaactgtccctaacccttatattttactcggcctgcttccaccagaacatacagcatacactgttcttgacttaaaggatgctttctttgctattcctctggcccctaaaagccaacctatatttgcttctgaatggatggaccctggctcaggagacaccactcaattaacctggacttggttaccccagggtttaaaaaattcccccaccctttttggggaagccctccaacaagatcttataccgttctgagccagtcaccctaactgcacgcttctccagtacatagacgacctgtttttggctactgaaaccactgacagctgcctgcaacatactagggacctactttacctccttcaggaactcgggtattgggtctcagccaagaaggcccagctttgtcttcccagacttttctacctaggatacaagataaacaagggagaaagggcacttgccactgctcgaaaggaagccatcctgcaaatccccactcccaccactaggagatgggtacatgaattcttaggggctgtgggatactgtcgtttatggatattggggttcgcagaaatcaccaagcccctgtacaccactaccagagggaatggcccacatgtttggactgacaaagaacaggcttttcaaaatctaaagaaggcattaactgaggtccctgctcttgccctcccaaatatctcagaaccatttcatctttttgttcatgaaagccagggagtcactaaaggggtactcactcaaactttaggaccatggtgatgcccggtggcctatttgtctaagatactggaccctgtggctccgggtgaccaagttgtctgtgagccatagcggcaaaagcaagcctggtccaggaggctgataaactgactctgggccagaatttaacccttatggctcctcatgccatagagactttgctacaaaggcgctctggcaaatggatgtcgaatgctcacatcctgcagtatcagagtttactgttagatcagccttggttaactttctctcccacaaggtgtttaaatccagctacctttctccctgatccagaccttaccacacctgtccatgactgccaagaactgttagagactacataaactggccgacctgatctccaagatgtgcctctaaaggaggtggactccactctgtttactgacagcagcagcttccttgaacagggagtaggaaaggctggtgcagccgttactatggagacagatgtactgtgggcccaggcactgccggcaggtacctcagcacagaaggctgaattggtcaccttcactcaggctctctgatggggtaaggacaaacgtattaacatctacactgacagcaggtatgtttttcctactgtacatgtacacaaagccatctatcaagagtgagggctactcaccaggaaagactattaaaaacaaagaagaaattttggccctgcttgaagctgtttggcttcctccgcaggtggctgtaattcactgcaaatgtcatcaaacagaaggcatggctattgcctgtggtaaccaaaaagcaggctctgcagctcgagaggcagcttggctcccagtcacgcctttgaccctgctgcccactgtgtcctttccgcaacctgacctaccagaccacccacaatactccccagaggaagaaaaacaagcttcagatctttgggccagtaaatatcaggaaggtttggtggattcttcctgattccagaatctttattgccccaagtcccctgggaaactttaatcaatcatctgcattctgccacccatttgggaggaataaaactggcccagcttcttaggagccatttcaacatcccccaccttcaggacttaactaaccaagcagctctctggtgtatggattgtgctcaggtaaacaccaaacaaggtcctaagcccagctcagtccaccctccagggaggctctccccgagaaaggtgggaagttgactttacagaaataaaaccacactgggcagggtataaatacctcctagtgctaatagacaccttttcgggatggactaaggcatttaccactggaaacgaaactgccaccatggtagttaggcttttactcattaaaatcatctctcaacatgggctgcctgttgccatagggtctgataatggaccagccttcacctcgtccatggctcagtcagtcagcaaggcattaaacattaaatggaaactccattgcacctattgaccccagagctctggacaggtagaacgcatgaaccacacaataaaaagtactcttactaagttaatcctagagaccagtgagaattgggtaaagctccttcctttagcccttcttagagtaagatacaccacttactgggctgggttttcaccttttgaaatcatgtatggaagggctcctctatcttgcctaagctaagggataccaatttagcagaaatctcacaagctaatttgttcagtacctgcagtctctccaacaggtatgagacaccatccagccacttgtccagggagcacactccaatccagttcctgaccagactggccctgccactttttccagccaggtgacttagtataggttaaaaagttccagaaggaaggattcactcctgcctgaaaaggacctcatactgtcatcctcaccacgccgatggctctgaaagtggatggcattccttcttggattcatcactgtcacatcaaaaaggcgaacaaagcccagcaagaaacatggatccccaagcctgggccatgccccttaaaactgcgcataagtcaagtgaagccatcggattaatcatttttatttacctcttttgtttgtttccgcctattacgccctctgcccctctctactcttttctcctcacttctttcacgacagtatgtgtgtttgcaaacaccacctggaaggcaggaacctccaaggaagtctcttttgcagtcgatttatgtgctttgttcccagagcctgcccaaacccatgaaaaacaacccaacctgccggttatgggagcaggaaatgtcaacctcgctgcagggtccagacacacaggaagccggactagatgtggaagctctaaaggtgcagaaaaaggactccagagcgttgacttttacctctgtcctggaaatcaccctgactctagttgtctagattcttatcagtttttctgccctcactggtcatgtgtaaccctggccacataccctggaggattgacctggtcctcaacacttt

SEQ ID NO: 46 - DNA, 319 bp, Homo sapiens
  repeat_region (1)..(319): hir
  ref <308>: DATABASE ACCESSION NUMBER: Database of repetitive elements (repbase)
  ref <309>: DATABASE ENTRY DATE: 1996-01-26
gattcccaggtgcacagagatcctaatccgcatccatcgaaatctcacaaagtgtccataaatcactcagggagggcccccatggatacagggccgtagtaggatgctcctatagtgggcattaatatgagaatgaccgaaaagtgcatttaggaccatattataattttcgggttcccaggtgcacgtttccaataaccaggtgcacggatgtatagggtcccccccatggatagaggtccgtgttagggtgctccatatcgggcatgaatatcaggaacaccggcatgtgcacttaggaccatgttttaatttttca

SEQ ID NO: 47 - DNA, 1158 bp, Homo sapiens
  repeat_region (1)..(1158): hres1
ggctcgctggggataatatcgcagctgaaaccgaacatcaagctggcttttcaaaccttcagttatttacattagactgagaggggaaaagcgctaagagtgcaagagcagagaaagagcaagaggaaacttgaaaaggcggatcacgcaatgcgctgtgcacacgcccccgccccgcgcacccgctaccccacccgagcccccagcggcccgcgtcccccatcccggtcccaagcccagacacctccgagatccgtcccgcggctccggccgcgccaccgccaccctcaagacccccgcagcccaggcccggccccgcgccaccgacgccccccgcggcccgacccgcgcgccccgccagcccgggcctcgtaccgtaggtttcggacatggccgtctgcgacatcttgggagcggcgccgcctctcgccgggtcaccgtgcactcgcccgcggtccgccggcgcgtctcggtggggaaggacctggggcgggggaccggaggagggaggggcccgaccggtccccacggcaaccgccggtcctcccagcggctgcggcccagccggactccagctccgcgcaggcgccagggccctccaccctccgtccggccgcgaccgcgaggaggaagaggagatgggctacgcgaggcccggcccaccccgcgttcgcgcgtgcgcacggggaggccggggcggggcgcgtgaggacttcggcgcgcgccggaagcacgtgcgcgggctgggcgctctggcggtgtgcgctgaggtgggcagagcggcaggtgggggcgttgggggctgagtcccgatttccctgagggagggtcgggtagaggcgggcggtgggcaggtttgggggtgacagagggctggggacagtggggtccagttgccggacagaggaggaaggtgcccgcactggggaggaaagcagtccatttgccaaattggcccgtctcagttaagacgttgtcttcggtcatcatctgcggctgtcagccaggaaaaaacttccctgacgctgttacgatggaggccagaacttggttaatgtgtaacaaggaggcagtaggccccaggtgtccagccagaggccgccctgtgaatgggaggcaggttcatttacccgttggacccgttgggaagctaagctt

SEQ ID NO: 48 - DNA, 631 bp, Homo sapiens
  repeat_region (1)..(631): hsati
  misc_feature (3)..(3): n is a, c, g or t
  misc_feature (6)..(6): n is a, c, g or t
  misc_feature (11)..(12): n is a, c, g or t
  misc_feature (45)..(45): n is a, c, g or t
  misc_feature (50)..(50): n is a, c, g or t
  misc_feature (57)..(58): n is a, c, g or t
  misc_feature (65)..(65): n is a, c, g or t
  misc_feature (119)..(120): n is a, c, g or t
  misc_feature (122)..(122): n is a, c, g or t
  misc_feature (133)..(133): n is a, c, g or t
  misc_feature (136)..(136): n is a, c, g or t
  misc_feature (147)..(147): n is a, c, g or t
  misc_feature (171)..(172): n is a, c, g or t
  misc_feature (223)..(223): n is a, c, g or t
  misc_feature (263)..(264): n is a, c, g or t
  misc_feature (309)..(310): n is a, c, g or t
  misc_feature (314)..(315): n is a, c, g or t
  misc_feature (318)..(319): n is a, c, g or t
  misc_feature (327)..(328): n is a, c, g or t
  misc_feature (333)..(333): n is a, c, g or t
  misc_feature (335)..(335): n is a, c, g or t
  misc_feature (344)..(344): n is a, c, g or t
  misc_feature (360)..(360): n is a, c, g or t
  misc_feature (376)..(376): n is a, c, g or t
  misc_feature (560)..(560): n is a, c, g or t
  misc_feature (586)..(586): n is a, c, g or t
gantcngctcnngacacaactctctgagccttcggtgacctttcngtctngtgtaanngcactcntgtcyycctggcagcagttggacctcgcgatgtggattgtgccctcacccagcnntntttatgccctntcnccatggtgacnggattaggggtctcctgctcttcnntcctaaggaccactgtctgtgctgtgtctttcaaaggtcagaagagattgnacctttgtgtttttattttccctgtgtttgctttttctcnntggggaacctgtgttgctgctttgaaggtatattcatactggccnntcanntgnncaacatcnncaaantnactagttanggctttcaaaatatgntatttcaaaaaattanccgtctgtattttccatatgcagttataagtaggtttcatcggttatgttttattcctcagtttatacatttgattattgtaccaagcagagtacctttgaaattttttttcatttaaaaaatatggatctttaaaaaaaaattatatatgatatatattacatgttatgtgctatgccttatntgtaacatataacctcatatattttntatgtcatagtatataatatttatcctgtgtcatcttatatatac

SEQ ID NO: 49 - DNA, 59 bp, Homo sapiens
  repeat_region (1)..(59): hsatii
  misc_feature (2)..(2): n is a, c, g or t
antccattcgggtccattcgatgatgatcacactggatttcattccataattctattcg

SEQ ID NO: 50 - DNA, 1287 bp, Homo sapiens
  repeat_region (1)..(1287): hsmar1
ttaggttggtgcaaaagtaattgcggtttttgcattgttggaatttgccgtttgatattggaatacattcttaaataaatgtggttatgttatacatcattttaatgcgcatttctcgctttacgtttttttgctaatgacttattacttgctgtttattttatgtttattttagactatggaaatgatgttagacaaaaagcaaattcgagcgattttcttattcgagttcaaaatgggtcgtaaagcggcggagacaactcgcaacatcaacaacgcatttggcccaggaactgctaacgaacgtacagtgcagtggtggttcaagaagttttgcaaaggagacgagagccttgaagatgaggagcgtagtggccggccatcggaagttgacaacgaccaattgagagcaatcatcgaagctgatcctcttacaactacgcgagaagttgccgaagaactcaacgtcgaccattctacggtcgttcggcatttgaagcaaattggaaaggtgaaaaagctcgataagtgggtgcctcatgagctgagcgaaaatcaaaaaaatcgtcgttttgaagtgtcgtcttctcttattctacgcaacaacaacgaaccatttctcgatcggattgtgacgtgcgacgaaaagtggattttatacgacaaccggcgacgaccagctcagtggttggaccgagaagaagctccaaagcacttcccaaagccaaacttgcaccaaaaaaaggtcatggtcactgtttggtggtctgctgccggtctgatccactacagctttctgaatcccggcgaaaccattacatctgagaagtatgctcagcaaatcgatgagatgcaccgaaaactgcaacgcctgcagccggcattggtcaacagaaagggcccaattcttctccacgacaacgcccgaccgcacgtcgcacaaccaacgcttcaaaagttgaacgaattgggctacgaagttttgcctcatccgccatattcacctgacctctcgccaaccgactaccacttcttcaagcatctcgacaactttttgcagggaaaacgcttccacaaccagcaggatgcagaaaatgctttccaagagttcgtcgaatcccgaagcacggatttttacgctacaggaataaacaaacttatttctcgttggcaaaaatgtgttgattgtaatggttcctattttgattaataaagatgtgtttgagcctagttataatgatttaaaattcacggtccaaaaccgcaattacttttgcaccaacctaa

SEQ ID NO: 51 - DNA, 1301 bp, Homo sapiens
  repeat_region (1)..(1301): hsmar2
cgaggggtcttcaaaaagttcatggaaaatgcgtattatgaaaaaactatgcatggatttcaaaaattttttgcaccaaaataaactcgtactaacttgttataacatgtctgaacaggatctagtttgaggcactaagaaggataagacatcagtttgaaaagagcccctatcagagcaacatgaattctgctaaaattgaagcaagaacaaacatcaaatttatggtgaagcttgggtggaagaatggtgaaatcactgatgctttacgaaaagtttatggggacaatgccccaaagaaatcagcagtttacaaatggataactcgttttaagaagggacgagacgatgttgaagatgaagcccgcagcggcagaccatccacatcaatttgtgaggaaaaaattaatcttgttcgtgccctaattgaagaggaccgacgattaacagcagaaacaatagccaacaccacggacatctcaattggttcagcttacacaattctgactgaaaaattaaagttgagcaaactttccactcgatgggtgccaaaaccgttgcgcccagatcagctgcagacaagagcagagctttcaatggaaattttaaacaagtgggatcaagatcctgaagcatttcttcgaagaattgtaacaggagatgaaacgtggctttaccagtacgatcctgaagacaaagcacaatcaaagcaatggctaccaagaggtggaagtggtccagtcaaagcaaaagcggactggtcaagagcaaaggtcatggcaacagttttttgggatgctcaaggcattttgcttgttgactttctggagggccaaagaacgataacatctgcttattatgagagtgttttgagaaagttagccaaagctttagcagaaaaacgcccgggaaagcttcaccagagagtccttctccaccacgacaatgctcctgctcattcctctcatcaaacaagggcaattttgcgagagtttcgatgggaaatcattaggcatccaccttacagtcctgatttggctccttctgacttctttttgtttcctaatcttaaaaaatctttaaagggcacccatttttcttcagttaataatgtaaaaaagactgcattgacatggttaaattcccaggaccctcagttctttagggatggactaaatggctggtatcatcgcttacaaaagtgtcttgaacttgatggagcttatgttgagaaataaagtttatatttttaatttttatcttttaattccattttccacgaactttttgaagtcccctcg

SEQ ID NO: 52 - DNA, 842 bp, Homo sapiens
  repeat_region (1)..(842): huers-p1
  misc_feature (326)..(326): n is a, c, g or t
aatttgggggctcgtccgggattgcccttgtggctacctgcccgtggtttggtagcccccctctggcgatggatccagaggccagcccaagtggccgcctagttctcttggactgggggctgactctggtactatctctctaccggtggggcgctgccgacccaatgtgcatggatttaattgcaatrgagaaatagtcctggggagacatcccataactgtagccctatcacagggtgtctgtctgtagccccattgcagggtgtctgtctgtagccccattgcggggtgtctgggttggtgagtattctaggcgctgccaacgnccccttccttctcctgactkgttctgtagccccctggtggggtgtctgttggtagccycacggggtgtctgtctgtagccccatcatggggtgtctgtctcagtttagctcctatggggtctcwgttggctctccctaactagtaggaagagtctgtggttrgggagacttctcctcaatcaggaagatttcagggagatttctcagacggagaataggagaatagtttggaagggatactcttggatttgagacttggtctgggatctgtgttttgaaggccttctgttcgtcttatctttgtgtgtgtttgtatatgtggaggggatctctgaaggaattgctgatggaagtccagcaggcctaactcagagaaccctccttatttgtctggtcacatttggtgagccctaaagaaagctcaacaggcctgtctyggggtgactatctgctcttcgccttgcccagagaccccactgtgaattaccatttggaggtcatccctccccacctgga

SEQ ID NO: 53 - DNA, 3088 bp, Homo sapiens
  repeat_region (1)..(3088): huers-p2
  misc_feature (96)..(96): n is a, c, g or t
  misc_feature (110)..(110): n is a, c, g or t
  misc_feature (242)..(242): n is a, c, g or t
  misc_feature (296)..(296): n is a, c, g or t
  misc_feature (331)..(331): n is a, c, g or t
  misc_feature (423)..(423): n is a, c, g or t
  misc_feature (610)..(610): n is a, c, g or t
  misc_feature (623)..(623): n is a, c, g or t
  misc_feature (639)..(639): n is a, c, g or t
  misc_feature (684)..(684): n is a, c, g or t
  misc_feature (732)..(732): n is a, c, g or t
  misc_feature (781)..(781): n is a, c, g or t
  misc_feature (862)..(862): n is a, c, g or t
  misc_feature (890)..(890): n is a, c, g or t
  misc_feature (899)..(899): n is a, c, g or t
  misc_feature (961)..(961): n is a, c, g or t
  misc_feature (1113)..(1113): n is a, c, g or t
  misc_feature (1146)..(1146): n is a, c, g or t
  misc_feature (1186)..(1186): n is a, c, g or t
  misc_feature (1243)..(1244): n is a, c, g or t
  misc_feature (1252)..(1253): n is a, c, g or t
  misc_feature (1432)..(1432): n is a, c, g or t
  misc_feature (1536)..(1536): n is a, c, g or t
  misc_feature (1557)..(1557): n is a, c, g or t
  misc_feature (1755)..(1755): n is a, c, g or t
  misc_feature (1974)..(1974): n is a, c, g or t
  misc_feature (2003)..(2003): n is a, c, g or t
  misc_feature (2031)..(2031): n is a, c, g or t
  misc_feature (2077)..(2077): n is a, c, g or t
  misc_feature (2122)..(2122): n is a, c, g or t
  misc_feature (2151)..(2151): n is a, c, g or t
  misc_feature (2226)..(2226): n is a, c, g or t
  misc_feature (2310)..(2310): n is a, c, g or t
  misc_feature (2550)..(2550): n is a, c, g or t
  misc_feature (2579)..(2579): n is a, c, g or t
  misc_feature (2598)..(2598): n is a, c, g or t
  misc_feature (2632)..(2632): n is a, c, g or t
  misc_feature (2634)..(2634): n is a, c, g or t
  misc_feature (2680)..(2680): n is a, c, g or t
  misc_feature (2698)..(2698): n is a, c, g or t
  misc_feature (2725)..(2725): n is a, c, g or t
  misc_feature (2759)..(2759): n is a, c, g or t
  misc_feature (2807)..(2807): n is a, c, g or t
  misc_feature (2909)..(2909): n is a, c, g or t
  misc_feature (2643)..(2643): n is a, c, g or t
actgggggctcgtctggaatcagcagcagggtgatktacagatgwggaactgtcggatgtgcctcttttctaagaccctgccacctctctttcttntgggtaaaaggctntgtttcccttcacagaggtctcgctgkcacgcgggactggagcagagwcctggggcwactgaaggcatcwtttgctggaaggccccgasactgaactctgtcggccaggacccccagacttcgcttggtgtnttttctctctctcacagtttamaaatggctcttatctcctttataatgttaagngttttgctacaggctgcggcaatgttactaagtanaatgagcatttggctcagccatcaaaggtgcaaatcagaacaatgtggtttccattttttcttagaggtgccatscttgcccccaccctganagccacaggcgcgcacggcgcagggcacctcccctccttaccccctcccctcccggctcaggcgcctgggcgtgcccacggcatgcaaaagccgcgcccaacagccacgaagggtgggagaaaaccgaggctgccgctgggaccccacggggctggctggccggtgcctcctctcagccgcgccaanggaacctttcctnccctggccaaggaatncaaactagtctgaaccggggaaaggatacaataattaaagggacncatttgcactgagcaaggggttcttccccccgactmccccctttttgncctttaaactgtttttcttttttccttttctaagtgagagggttccctncccakcactctgcttctgatagggaagttaacagaggassagcgacccctgctggcggatagctgcaaattcggcagggcncatttgagacaatctaaacagatagatncagcccctnaaatatctttttagtcccaaacttgattccaagcttcaggttgaggccctagaaagaaaaancagatctgagggatccaaagccaggcaacaggcacaatgtaaatgggcaggaccaattcctgctgactaaacccccgccccatggaaggaggccatgctccttggcataaacgaggcccagggaactcaaaggttgtcgacagcagggaganagggaggcataggcgagggcggatcattcctwntctccgggccttccctgcttcatggatgaatgccacattngcacccatgggtggcacctgccaaggtcaccgggactcggggataaaaagtggaaanngaaaggannatgctcgctttctctccccatcacaccctgagttttcactgaaagaaggaagggaaatgagggacgcctctattccctgtctttcagaacgggcaaccagctctcttcaccacccccagcttatactcctctggagtgtatcctgaaccattgggactgctttgaccctcggaatctgnaggaaaaacgcctcatagccctctgcacaaaggtttggccaaattatgacttacaasaaggactagcttggccttaggaaggaaccgttcattttgataccatncggctgttggaccttttctgnaaacgtgaggacagatggtctgaggccccatatgtgcaggctttctataccttgcagggcaatccagacctttgccgacagtgtaggattgatccagccctcctgtttgccatctcaggagaggctgcaaggggcaatcccagggaactaaagawacgagtcccagaggcacccccagcagagaagccagctccctcnagccctgctcctccgggtccaccctgacctccctatccagcttcagcctctcacttgccccctcctagaaattctcaccctagacaagccccggtctcactcttgctcctccaacagatgcctggtgaatttggccccagtaaggtccaggtccccttctctctacaggacttaaagcaaattaagggggatcttggcaagttttcagatgaccctganagatatatagaggctttccagaatttcanccaaatatttgaactctcctggagaganagttatgttacttttgaatcagaccctgatggacactgagaagcangccgctctgcaagcagcagagagatttggggatgagctttgtatnacatatagcatcaggaaagggggcgaatnttatccaactggaagagaagcagtaccagtgaatgaccctggatgggatcccaatgatgagatgggagactggangaggagacactttcaggtgtgcataaggagggcttacgtaggactaggaccaaacmcctsaactataccmmgttatccatgatngaccaggaatttgatgaaaatctcattgccttcttggaaaggctaagagaggccttggtaaagcacacctctctatctcctgattcagtcgagggacaactaatcctaaaggataaatttattactcaggcagcccctgatatcaggaggaagttgcagaaacgggccctgggaccagatagtactttagaggacctcctgaaagtggccacctcggtcttttacaatagagacagaggnccaggaccttgagttcagtagacacaggnaagagacctgggaagcttnagtagccaccgtgtaagcccacaaaccccagaantnccaaggtgnacctgttaactgctaaagatatggcaagaatagttanctccttctaaagtttatntgctctcgtacaagstttaatttcttncaccagggstgacccaamasctcagggtacaatnttgctgttagtatatttcacttcttatttctgtaatctttggcactanattctttccttgtataatacacgtttaacccatgcatacttaaccttatagaackkgttttttttttttctcacgcctagaggccatcaaactccaaatggncaggcaactgaagcctcggacaatgactcccctttgccaggaacccttagatagacctctgggagaaatttgactgccgttttccccaaaacaacgccccctgtcggcaggaagtagctaagaccggtcatcgtccatattctaatggcagttagatgtgcctcttcagagaggggaaa

SEQ ID NO: 54 - DNA, 8919 bp, Homo sapiens
  repeat_region (1)..(8919): huers-p3
  misc_feature (16)..(16): n is a, c, g or t
  misc_feature (159)..(159): n is a, c, g or t
  misc_feature (175)..(175): n is a, c, g or t
  misc_feature (429)..(429): n is a, c, g or t
  misc_feature (463)..(463): n is a, c, g or t
  misc_feature (722)..(722): n is a, c, g or t
  misc_feature (897)..(897): n is a, c, g or t
  misc_feature (1183)..(1183): n is a, c, g or t
  misc_feature (1412)..(1412): n is a, c, g or t
  misc_feature (1666)..(1666): n is a, c, g or t
  misc_feature (1678)..(1679): n is a, c, g or t
  misc_feature (1851)..(1851): n is a, c, g or t
  misc_feature (2231)..(2231): n is a, c, g or t
  misc_feature (2513)..(2513): n is a, c, g or t
  misc_feature (2640)..(2640): n is a, c, g or t
  misc_feature (3388)..(3388): n is a, c, g or t
  misc_feature (4479)..(4479): n is a, c, g or t
  misc_feature (4559)..(4559): n is a, c, g or t
  misc_feature (4684)..(4684): n is a, c, g or t
  misc_feature (4771)..(4771): n is a, c, g or t
  misc_feature (5753)..(5753): n is a, c, g or t
  misc_feature (6084)..(6084): n is a, c, g or t
  misc_feature (6104)..(6104): n is a, c, g or t
  misc_feature (6132)..(6132): n is a, c, g or t
  misc_feature (6279)..(6279): n is a, c, g or t
  misc_feature (6301)..(6301): n is a, c, g or t
  misc_feature (6331)..(6331): n is a, c, g or t
  misc_feature (6569)..(6569): n is a, c, g or t
  misc_feature (6992)..(6992): n is a, c, g or t
  misc_feature (7036)..(7036): n is a, c, g or t
  misc_feature (7153)..(7153): n is a, c, g or t
  misc_feature (7226)..(7226): n is a, c, g or t
  misc_feature (7245)..(7245): n is a, c, g or t
  misc_feature (7330)..(7330): n is a, c, g or t
  misc_feature (7422)..(7422): n is a, c, g or t
  misc_feature (7505)..(7505): n is a, c, g or t
  misc_feature (7562)..(7562): n is a, c, g or t
  misc_feature (7573)..(7573): n is a, c, g or t
  misc_feature (7638)..(7638): n is a, c, g or t
  misc_feature (7820)..(7820): n is a, c, g or t
  misc_feature (8003)..(8003): n is a, c, g or t
  misc_feature (8012)..(8012): n is a, c, g or t
  misc_feature (8051)..(8051): n is a, c, g or t
  misc_feature (8087)..(8087): n is a, c, g or t
  misc_feature (8120)..(8120): n is a, c, g or t
  misc_feature (8220)..(8220): n is a, c, g or t
ttttggggsattggcnaggataccaaggtacaacattcattgraacggtgagtataggagcgractccaactctgtcctttcattccgaggctctcttggcctccattttaaaatcaaatcaaatcaataacgggtatccgtcagccagttaaaaacgnttagcgcggctgccgntcttaaagactcggatgwcaggcttgctggggagaacatggagaatcccccagcacccacgggttgttgggaatgttggccatgtttgaaccagcttcctttcacggagrrcctagccgtcacgtggggctggaagaagtcctgaggcaactgaggatttctggccggggctacaccccggtgttatccaaaggcttctggaccgaccccagcctccgacagcccattggggtgttggcaacaggatctccaancttccttttgctatcgcaatttcctcctttcctntctcagtsaccatgtctcttatcctctctgtgtatgcaatgtgcgggaatttttacagttcagggaagtaatcctgttwgacaagatcagggaatgtcgtagtaaccagggatatagctcaagggaaggcgtctttgtgattttctaggaacagagggcccccacatccccagtgaacatctctctctgcccttggtctggagagcacatggmacttccaggtctctctctscccttggtctggagagcacatggcatntcaaggctactgcccttggtctggacagcacatggcatttcaaggtcaacagcgccacctagtggaataggaatcctctccatgaggcacattgtcggtccttcaccgaaacactctagcttcccaattctcccctctttttgcgcctctctactagaaatcaggcttcatgcyncttctgtgaacgggaaaaytctgctttcaacarytaggagtaaaatatcctccgwagccaaattttagtctcgatactgtcccatcagcaggaaaacggccattcggtccctacgttcttttaaggcacctattctgtctccaattaraatggtacttaattagtaaggggattttaagtycggaagttaaccggaaccatttttctctaagggtaaatgctttagcatgggccataatagcaggatatagagctcaatctagcacgctccctccgttaaaggggncttgcccaaatgcaactgttacatagtctctcccgagatccattttttagggagccacgcaggtcacacaagtctaggaggtcaaagggaaatcacaggcagaggactagggctgcttgggtaagcgtgactaatcccaacacttagttcctccggttccatggcttggagggtcacgcctgcaaccatgggcggcacatttaacaaggtgccgggacccaggaaccanggagggaaaacagcaggggggacgccccctactgtcttcctctccaccctgggtcayaccaaaaggaaggagactaaaggaacgcttttwttctcacttctctttctagatgggtaacagatcatcttcagcctgcactcctctggagtgcattctgaagcactgggactccttcgaccctgagactttgaagaaaaagcggctcattttcttttgcacaagggcatggccttcttaccatcttggggacgaanargcctggcccnntgaggggagccttaattttaatattatccaacaattagatcttttctgcagacaggagggcaaatggtccgaggtccttatgtacaggctttctttgccctgcgagacaacccagacctttgcaagcgttgcamaatcgacccagctcttttagcaatcatatcaggcaggnccaaagagaatgattccccaaaaytagaaaagcaacttccaggggaaccatctgaggcagctatcgaatgtcccagcccttccagtcccccttatctggggccacctccaaccacgccaccagctcctccasctccaccatctccaaaatttcccactcccccaccttcactcttacccctacaggaaatgcccgatggaggtgatgccactagggttcaagttcccttctcattacaggaccttaggcaaataaagggagacttaggccgattttctgatgaccctgataggtatatagaagctttccaaaatttaactcaggtatttgacctcwcatggagggatgttatgctgctcctaagccaaaccctaactgcngctgaaaaacaggcagctctgcaggcagcagagaatttcggagatgagcaatatgtctcctatagyaggccaaaagggaaaagagaaaatagggaaggcgaagaaataggggaaacaccattcccaataggaagagaggcagtacctcttgacaaccctaattggaaccccaatgacgcagkagatgaatggaaaagaaaacactttttaatgtgcatattagagggcctatggagaaccagggccaaacctcttaattactctaaactgtctatgatagancaaaagccagatgagaatcccgcagcctttatggaaaggctgagagaggcactaataaaacacacctccttatcccctgattcagtcgagggacagctaatcctgaaagacaagtttattacacagncagctcccgatattagaaggaaactacagaaacaggctataggaccagatagcaccttagaaaacctcctgagggtggccacctcggtcttttataatagggaccaggaggaggcccaagagaaggagaggaaacacaagwgaaggacagaggctctagtagccgctttgcaggcttgcaaagtccaggatccccgaggtgcatctgctagttgctatcagtgtggcaagtcagggcactttaaaaaggagtgcccaggcagcaagaagaagccacctcgaccctgtccagcctgtggcggggaccactggagatcggactgcccccggaggcggaggtcactgggttcagaaccagtctcacagatggtccagcaggactgatgggtcccggggctcaaacccctggctccagcggctcaaactgccattacagcacaggagccccgggtgattctggaaattgaaggaaggaaggtagacctccttctggacactgaagccagtctctctcctctcctctccaatccaggcctcccctcttcccatagcacgaccatgaggggcgtctcaggaaaaactctaacccgatatttttctcaaccccttagttgcagttggggggacctatgtttacacatgcctttttaatcatgcctgaaagtcccactcctttattaggtagagacattctagcttgcatgggggccagcatccttatggccccaggacaaactctttgtctcccnctggtggaagctaatattaatccggaagtgtgggcaactcaaggaagaatwggtcgagctataaccactaggccagtccagatccatcttaaggatcccacttcttttcctaaccagagacaatattccctaaagccagaggctaggaaagggctagaagccattattaataacctgaagatgcagggcctcctcaaaccctgtagcagcccctgcaacaccccaatattaggagtgcaaaaacccaatggggaatggagactagttcaggacctctgcctcattaatgaggccgtagttccaatccatccagtggttcctaatccctataccttgctgactcaaatacctgagggaactaaatggttcacagtcctagatctaaaggatgcctttttctgtataccattacatcctgactctcaatacccgtttgccttcaaagatccctccggccaaaccgcccagttaacatggacggtgctgcctcagggattttgagatagccctcacctgtttggacaggcactgtcaaaagacctctctgagttctcccatcctcaggtcaaggttttgcaatatgtagatgacattctgctctgtgccccaactgaggaagcttctcaggaaggcactgaagctcttcttaatttcttagctgacagaggatataaggtttcaaaatccaaggcccagctctgcmaaacctcagtgaagtacctgggtttagtgctgtctgaagggaccagagcattaggggaggagaggattaagcmcatttcctccttccccctccccaaaaccctcaagcaactgagaggattttggggcattacaggattttgcaggctatggatacccgggtatggtgagatagsttgccctttatatcacctcataaaagaaactcaagcggctaaaactcatctcctaacctgggaacctgaagctcaaaaggcctttaaccagctaaagcaagccttgcttaaggcaccagctctcagccttcctgtagggaaggccttcaatctttatgtatcagaaaggaagggaatggccctgggagttttaactcaggcccgaggaccagntcaacagccagtgggttacttgagtaaggaacttgatttggtggctaaaggatggccagcatgcctccgagccgttgccncagtggccctactggtcccagaagcctccaaattaaccctgggaaatgacttaactgtttataccccacataatgtggcaggattactgtcctctaggggaagcctttggctaacagacagccgnctccttaaatatcaggctttgctgttagagggwtccacmatccagttaaaaacttgctctcacctaaacccagacactttcctcccngaggaaactggggaacctgaacatgactgtgaacaaatcgtagtacagacctatgcagccagggaagatctcagggaaactcccctagaaaatccagactggaccctcttcatggatgggagctcctttgtagaacaaggaatccgtaaggcgggatatgcagtagtcactctaaataacgttattgaaagtgcgccwctctctccaggcacaagcgctcaattagctgagctgatagctcttacaagagcacttgaattaagcaaaggaaaggtagctaacatttacactgactccaagtatgctttcctagttctccatgctcatgctgccatttggaaggaaaggcactttcttaccactaatgggtctcctataaaataccatcaggaaattaacaggttattatcctcagttttccttccacgagaagtagcagtgatgcattgtaggggacatcagaagggaacagatgaaatagccaaaggaaacaagttagctgatcaggcagctaagtcagcggcaaggaagcctcaaggcatcaacacacttcaagcccctctaatctgggaaggctccataagagaaattaagcctcagtattcccctacagaaatagaatgggccacttctcgagggtatactttccagccctcagaatggctacagtcagaggatggcaaactccacttgccagcctccagccaatggaaagtccttaaaatccttcaccaagcttttcacttgggaaaggataaaacttatcaatgtgcccaaagattgttttcaggagagaacttactaaaaacagtcaaacaggttgttaatgcttgtgaagtctgtcttaaaaataatcccctgaacagacggctccttcctcctcaaacccaaaggatggaaagctatctaggggaggactggcagatagacttcacccacatgccaaagacaaagggcattcaatacctcctgkwgtgggtanataccttcactaactgggtagaagcatttccatgccgtacagaaaaggcctctgaggtagtaaaagtattagttaatgaaataactccccgctttggtctacctaagtacctccaaagtgacaatggcccctcatttaaggcagccgtcacacagggggtctcaaaggcactaggatacagtatcatctccattggcttggagaccccagtcctcaggaaaggtagagaagacaaacgatatcatcaaaagacacctcagaaaactgtcccaagaaactcaccttccttgggtcactcttcttcccatggctttactacaggtaagaaatnccccttcaaagttaggtctnagcccttttgaaatgctgtatggacggncttttcttaccaatgattttctattagaccaggagacctctgaattggttaagcatgtaacctctctggctcacttccaacaggaattaacacaactagcagaagcccaaccccaggaaataggaccacctttattcaacccagganatttggtattggtaaagkmtcnacctwctctctctccttctctaagcccaancagggagggcctcacaccgttctccttccaacgcccccggcagtaaaagttacaggaatcgactcctggatacatcacactcaagtcaaagcctggaaagctgagggagcaacccccgacagcccagaggaacgtcctgaatatcaatgtgaagaaataggagatcttaagctgaaaatcataaaagataagtaamtgagtgagggctactcatcctactcagtcccacccctacctnagcagatactttckgtcatttctacctttcctctcgaggtkcgccaccaaatattagaacttctttttgamwcatacttgcaggsagmttttgattgtcatgggattgcatttgtaacttcatagacccccaaaggagaattttacatcttggcgagtaaaattttagatggaaattatttactactccacacttgtgggaactgctatmctcactctactatttgcagtagggctatacactgtagcaccctcagagtggaatattggacagagaatctcaattgctatagtattttgcttaattattatccttatagcagggataatagttgmagaaaagaagtgaagatgaaagttttactatcactgagtctgctaggactttttattgggtttagtaatacgtcacaccgtttagctnctacaatatcagccatggcccatttatacagtaagactaattgntgggtctgtcctgagcggtttgctcagttcagtaacactaaggaacctcttgatgacccggaacttaccgtcttaggattccctttgttagctttacctttaaccattaaagacttntcaggcataaatggaacatggtatgggaacactttcaactgggtaactaactcctcccaggaaaacactcctnccccggtgccagaaaacantctccccaaagataagcttcacaccctcaggctaggaaaagttgaccgagtaatagcaaatgcctccctctgctttaaaagcagnggaaaagaaccatacttgggakatctcaaacattgtaacacatcacacttgtaattgctgaaagctcagaggtttggagaagaaaacgcaanaaggatgatctaaaagggaaaatggaagccctacgcgggggggctttcagaatctagcstctcctcctggttggaagtcccgntgggaatggcaggctctaggtaaccgccttgacacatggcactataatgtaaaaaanaacacataggncttcccaaacatgccccctcatggaattccagacccttgtatgatgcttgctaatagtagcggcntacaaatctgtgggcgaacaggagacatctggactgacggcccttgccacaaggattatctgagatattggccagggcatattgtgtccctgatcttttaaaactccatttgtcaggtggacccttctcatttggcgtgtaaaattccaaatggcatcgtgaatgactatcctgaatatggntatccctatcccaaagatgctcctattatatgtaaaaagaggaagcttctaagatatgagaaagatctgcctgtgtctctcacaagccacaacttagaaccgtcccttcaaggaacagggctatatttcctttgtggctcctggatacacttaatcctccctaggcactggaagggaacctgnactatagtngcagtggttcccgacctactatctttaaattccaccganatggcagcatcatctggggacatccctaacctagcntcttttctagagactgcgctatctcggatacancgaacaaagagatctatcatttccatgccctcgtatggagatttaactgaaagagaagactggggaggacatgcacatgacaatcctatcttagaaaaancatggataggggattctatagccagaggcctattctggtttgctggtattcctctccttgaaagatcagtacttaatatttctattatgatgcaacgagggtagaaggcaacagtaggagccatagaagcacaacmacaattcatagactctttagcctcagtagtagcgcaaaatagacaggccctagatgtccttacggccgaagtagggggtacctgtgcacttttaaatgaaacatgctgcttctggatcaacacctctagtmaagtagaggagaatctacaggtgcttaaagatcaaatcagaatcattgacaggctaagagaaaatgcgggctccagtcccaggtggctacaatccctctttaatgaattccagtcttctttatggaactggttagctcctttattaagctccctcttgctcatgtgttttgtattaatatttggaccttgtatactcaatactataactcgaattgtttcctctcgcctagaagcaatcaaactccaaatggtgctgcagaccgaaccacacatagacacgccattcttccaaggacccttagatcgaccccaggaggagccctagctgctgttccccacacgacgccccttttcagcaggaagtagccagaaagagtcgtcgtccaacaccccctaacagcagttagggttaccactccwgagggggggaa

SEQ ID NO: 55 - DNA, 95 bp, Homo sapiens
  repeat_region (1)..(95): hy3
  misc_feature (8)..(8): a is a, c, g or t
  misc_feature (76)..(76): a is a, c, g or t
tagtcaantgaagcagcgggagtggagaaggaacaaagaaatttgtaactggttgtgatcaattagttgtaaacancgctgcactccaaccagcc

SEQ ID NO: 56 - DNA, 854 bp, Homo sapiens
  repeat_region (1)..(854): in25
  misc_feature (131)..(131): n is a, c, g or t
  misc_feature (137)..(137): n is a, c, g or t
  misc_feature (144)..(145): n is a, c, g or t
  misc_feature (272)..(272): n is a, c, g or t
  misc_feature (318)..(318): n is a, c, g or t
  misc_feature (396)..(396): n is a, c, g or t
  misc_feature (415)..(415): n is a, c, g or t
  misc_feature (417)..(417): n is a, c, g or t
  misc_feature (420)..(420): n is a, c, g or t
  misc_feature (449)..(449): n is a, c, g or t
  misc_feature (554)..(554): n is a, c, g or t
  misc_feature (591)..(591): n is a, c, g or t
  misc_feature (627)..(627): n is a, c, g or t
  misc_feature (314)..(314): n is a, c, g or t
  misc_feature (479)..(479): n is a, c, g or t
gtggaaagttcctcatagcagagacacaattgcagtgctgggtacagtagggaaagtctgcacctttaccccaacaggcaggcagcctctgtgatcatgaagggtcttggagaagggatccttgttccccnctggcnctggtannccactgcagacacagctggggcttctcccacaggaacgcagcatggatgcacctatagacagcattcctggaacaattcagggtgattgcagccccacaggaggagcactctccagattcaggcctncatgagaggcagtcacaattcctccctacttggaacatcaanattnctacagatgaaaagaggtgcctgtctgatctgaatagctggaacactgggacaggagtgaggctgtgaggtggacagntttcctgctgacctggcangnganctgaggtagctcccacccttcaccctganaaaacctcagcacatctaattgagagctcncccagccaccctcatcaaggctgggacctttgcccactattggatattaaatctacccacctactttagctacanctggtgcctacccagggatacctcccttattgccctnaagcctgaatcatcaactcagtaaataaaatactgnsgagggaaaaattaaataaataaataaataaagtgtacacyackagagaacgagataagcttcawgagaycyctgccattccaacyccataggagacagtgaactcgcycacacaccaaghacgtmactactacaaccagcatctgrgaaakycakcacacaaagactctctataacyaaggaactcatacagagtcttcacccctamaagcaccmagagycaaatt

SEQ ID NO: 57 - DNA, 30 bp, Homo sapiens
  repeat_region (1)..(30): ivr
caggaggggcagctgaagcacctggagcag

SEQ ID NO: 58 - DNA, 337 bp, Homo sapiens
  repeat_region (1)..(337): ker
  misc_feature (160)..(160): n is a, c, g or t
  misc_feature (162)..(162): n is a, c, g or t
  misc_feature (210)..(210): n is a, c, g or t
agctcatctgtccactgaagatgcttggacagagttaggaatgcttcctgggagaggtaacatttgagactttcctggaagaatggtcagagtaaaccaagtaagtaggaatggaaagaggatgggaggccccagcttcccagaggcataaggtgaggangnccctatgcattcagatgtggcccaccctggggtctggtggactaaagncttggacaccccagatcagccttagtgggatgaggcaggaaagacagctgagggtcagaacccaggcaggtccaatgccagggtgggcatttcgagttggtgagacatttcaccctggtgccaagct

SEQ ID NO: 59 - DNA, 5403 bp, Homo sapiens
  repeat_region (1)..(5403): l1
gggggaggagccaagatggccgaataggaacagctccggtctacagctcccagcgtgagcgacgcagaagacgggtgatttctgcatttccaactgaggtaccaggttcatctcactggggagtgccagacagtgggcgcaggacagtgggtgcagcgcaccgtgcgtgagccgaagcagggcgaggcatcgcctcacccgggaagcgcaaggggtcagggaattccctttcctagtcaaagaaaggggtgacagacggcacctggaaaatcgggtcactcccgccctaatactgcgcttttccgacgggcttaaaaaacggcgcaccaggagattatatcccgcacctggctcggagggtcctacgcccacggagtctcgctgattgctagcacagcagtccgagatcaaactgcaaggcggcagcgaggctgggggaggggcgcccgccattgcccaggcttgattaggtaaacaaagcggccgggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcccagcacgcagcttcagatctgagaacgggcagactgcctcctcaagtgggtccctgacccccgagtagcctaactgggaggcaccccccagtaggggcggactgacacctcacacggccgggtactcctctgagacaaaacttccagaggaacgatcaggcagcagcatctgcggttcaccaatatccactgttctgcagccaccgctgctgatacccaggcaaacagggtctggagtggacctccagcaaactccaacagacctgcagctgagggtcctgtctgttagaaggaaaactaacaaacagaaaggacatccacaccaaaaacccatctgtacgtcaccatcatcaaagaccaaaggtagataaaaccacaaagatggggaaaaaacagagcagaaaaactggaaactctaaaaatcagagcgcctctccttctccaaaggaacgcagctcctcaccagcaacggaacaaagctggacggagaatgactttgacgagttgagagaagaaggcttcagacgatcaaactactccgagctacgggaggaaattcgaaccaacggcaaagaagttaaaaactttgaaaaaaaattagatgaatggataactagaataaccaatgcagagaagtccttaaaggacctgatggagctgaaaaccaaggcacgagaactacgtgacgaatgcagaagcctcagtagccgatgcgatcaactggaagaaagggtatcagtgacggaagatgaaatgaatgaaatgaagcgagaagagaagtttagagaaaaaagaataaaaagaaacgaacaaagcctccaagaaatatgggactatgtgaaaagaccaaatctgcgtctgattggtgtacctgaaagtgacggggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttacccacaaagggaagcccatcagactaacggctgatctctcggcagaaactctacaagccagaagagagtgggggccaatattcaacattcttaaagaaaagaattttcgacccagaatttcatatccagccaaactaagcttcataagcgaaggagaaataaaatactttacagacaagcaaatgctgagagattttgtcaccaccaggcctgccctaaaagagctcctgaaggaagcgctaaacatggaaaggaacaaccagtaccagccgctgcaaaaacatgccaaattgtaaagaccatcaaggctaggaagaaactgcatcaactaacgagcaaaataaccagctaacgtcataatgacaggatcaaattcacacataacaatattaactttaaatgtaaatgggctaaatgctccaattaaaagacacagactggcaaattggataaagagtcaagacccatcagtgtgccgtattcaggaaacccatctcacgtgcagagacacacataggctcgaaataaaaggatggaggaagatctaccaagcaaatggaaaacaaaaaaaggcaggggttgcaatcctagtctctgataaaacagattttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacaataataatgggagactttaacaccccactgtcaacattagacagatcaacgagacagaaagttaacaaggatacccaggaattgaactcagctctgcaccaagcggacctaatagacatctacagaactctccaccccaaatcaacagaatatacattcttttcagcaccacaccacacctattccaaaattgaccacatagttggaagtaaagctctcctcagcaaatgtaaaagaacagaaattataacaaactgtctctcagaccacagtgcaatcaaactagaactcaggattaagaaactcactcaaaaccgctcaactacatggaaactgaacaacctgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatctaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaagatcaacaaaattgatagaccgctagcaagactaataaagaagaaaagagagaagaatcaaatagacgcaataaaaaatgatacaggggatatcaccaccgatcccacagaaatacaaactaccgtcagagaatactataaacacctctacgcaaataaactagaaaatctagaagaaatggataaattcctcgacacgtacactctcccaagactaaaccaggaagaagttgaatctctgaatagaccaataacaggctctgaaattgaggcaataatcaatagcttaccaaccaaaaaaagtccgggaccagatggattcacagccgaattctaccagaggtacaaggaggagctggtaccattccttctgaaactattccaatcaatagaaaaagagggaatcctccctaactcattttatgaggccagcatcatcctgataccaaagcctggcagagacacaacaaaaaaagagaattttagaccaatatccttgatgaacatcgatgcaaaaatcctcaataaaatactggcaaaccgaatccagcagcacatcaaaaagcttatccaccatgatcaagtgggcttcatccctgggatgcaaggctggttcaacatacgcaaatcaataaacgtaatccagcatataaacagaaccaaagacaaaaaccacatgattatctcaatagatgcagaaaaggcctttgacaaaattcaacaacgcttcatgctaaaaactctcaataaattaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagatgacatgattgtatatctagaaaaccccatcgtctcagcccaaaatctccttaagctgataagcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccacatcgccaagtcaatcctaagccaaaagaacaaagctggaggcatcacgctacctgacttcaaactatactacaaggctacggtaaccaaaacagcatggtactggtaccaaaacagagatatagaccaatggaacagaacagagccctcagaaataatgccgcatatctacaactatccgatctttgacaaacctgagaaaaacaagcaatggggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcaataccattcaggacataggcatgggcaaggacttcatgtctaaaacaccaaaagcaatggcaacaaaagccaaaattgacaaacgggatctaattaaactaaagagcttctgcacagcaaaagaaactaccatcagagtgaacaggcaacctacaaaatgggagaaaatttttgcaacctactcatctgacaaagggctaatatccagaatctacaatgaactcaaacaaatttacaagaaaaaaacaaacaaccccatcaaaaagtgggcaaaggatatgaacagacacttctcaaaagaagacatttatgcagccaaaaaacacatgaaaaaatgctcatcatca

SEQ ID NO: 60 - DNA, 1883 bp, Homo sapiens
  repeat_region (1)..(1883): l180_5
  misc_feature (60)..(60): n is a, c, g or t
  misc_feature (164)..(164): n is a, c, g or t
  misc_feature (1375)..(1375): n is a, c, g or t
  misc_feature (1380)..(1380): n is a, c, g or t
  misc_feature (1427)..(1427): n is a, c, g or t
  misc_feature (1694)..(1694): n is a, c, g or t
  misc_feature (1728)..(1728): n is a, c, g or t
  misc_feature (1762)..(1762): n is a, c, g or t
tttttttcccaagatggcggattagaggcttttagtatgcctcagccacttggaaatggnaaaatagtgcataaagatcaactctgtgagctttaattcaagaaggaaaatgggaatccaccataatcgtgaaggacaccccagatcctagggaggagaatgtnggcaaacagcccctatgatggcgtccagctgataaaagtgagtgaagccccagtacgcgagagaggcagagagtctccctctgtgactcacttttccactggggatccgagcaacccaggccaagggagaacactttgtttctcccaagccctggagctaacgtggggagaggcttggagatgctgtgagggaaagacaccgggaaaagctgcagacattttcccagacctaggamcaagagcaggatgccatttttaatccgggcgcatacaaagtcagccattctttggcgacccggcagcgtggccgcgcaggcattttagtctcaggccagagattggagcgcctgctctggagtagggtaggggcctccacagccagaactgtgaaaagcgcctcagcagtaggcgctggaattgtgctctcccctactgcaagcctggggcgggaggagagctgctacagctgcagtttctcctgggcggcgagacttgcagccagggccagcttggcgacctggaactggtctgtgtgtgccattgctgggtgccccagcctgctcccctgagatcgtggtgcagsggggccctctctgctccacgcccaggcagatctccaggcattcagagcacccgctcgcctggwtcagcagcctgagccgccccacccttcctgkgcatagatcgtggtgcagsggggccctctctgctccacgcccaggcagatctccaggcattcagagcacccgctcgcctggwtcagcagcctgagccgccccacccttcctgkgcatagatcgtggtgcagsggggccctctctgctccacgcccaggcagatctccaggcattcagagcacccgctcgcctggwtcagcagcctgagccgccccacccttcctgkgcatagatcgtggtgcagsggggccctctctgctccacgcccaggcagatctccaggcatctggagcacccactctcctggattaggagtttaagccgccccacccttcccgtgcagagaacttggggctgaggaggtttccctgctccacgcctaggcacacctctgggcgcttggtggctgcccactggattctcccttggcgctggcgcttgtgcccgccatgggagatctgtaggcggacctgcctagtccggccccacccatcttggmccccgcccctccagggctgagcagrsagttcagancactntgcattccatgcatcagcccattkcctgaggcaacagagagcttctnccagtaaacaaggatcaaatatatacccagccacactggccgtagctagctcttacctataagcgccatctactggcttgtaggtcaaactgcacwgcccaatataaaacctgctaaaagaagtgcatagggctatagaagcaaagccaaaagaccatacccagcattctctacagtcacaccmcctagggaggaggagaaaggaaagggaaagaaaaaacaccaataatattatagggaaagaaagaaaagaaaaaaccctactcncatggaaataattacaaaaattagaagtgccagnatctccagatgagaaggaaccagcacaagaattntggcaccatgaaaaatctgaatgtagtgacaccaccaaaggatcgcactagctctccagcaatggttcctaatcaaaacggaaactcagaaatgacaggcaaagaattcaaagcatggatt

SEQ ID NO: 61 - DNA, 2890 bp, Homo sapiens
  repeat_region (1)..(2890): l1m2_5
  misc_feature (379)..(379): n is a, c, g or t
  misc_feature (543)..(543): n is a, c, g or t
  misc_feature (596)..(596): n is a, c, g or t
  misc_feature (680)..(680): n is a, c, g or t
  misc_feature (715)..(715): n is a, c, g or t
  misc_feature (745)..(745): n is a, c, g or t
  misc_feature (1195)..(1195): n is a, c, g or t
  misc_feature (1363)..(1363): n is a, c, g or t
  misc_feature (1747)..(1747): n is a, c, g or t
  misc_feature (1977)..(1977): n is a, c, g or t
  misc_feature (2049)..(2049): n is a, c, g or t
  misc_feature (2049)..(2051): n is a, c, g or t
  misc_feature (2062)..(2062): n is a, c, g or t
  misc_feature (2159)..(2159): n is a, c, g or t
  misc_feature (2166)..(2166): n is a, c, g or t
  misc_feature (2224)..(2224): n is a, c, g or t
  misc_feature (2249)..(2249): n is a, c, g or t
  misc_feature (2266)..(2266): n is a, c, g or t
  misc_feature (2273)..(2273): n is a, c, g or t
  misc_feature (2752)..(2752): n is a, c, g or t
  misc_feature (2881)..(2881): n is a, c, g or t
  misc_feature (2154)..(2154): n is a, c, g or t
  misc_feature (2332)..(2332): n is a, c, g or t
caaagaaatgtatktatgcaggagggcttcaagatggctgactagaggcakccggtactcgcctcctccacaaagaagaaccaaaatagcgagtagataatcacacttcgaatagakcatctaagagagaacactggaattcaacagagaagcgacaggaaacacctaaagcaaggaaggagaaggaagcgaggcagcctgctcggccgggattggctgggagccaggagaggctccccaatgcggggaaagggtaagtgagagacccccagcggtccacattcccaccacggactcctgcaatcctagccacgagagagcccctcaaccctcgcgggccctgagactaacatagggagctgcctggagwccgcgcganggcattgctccagagagggagctcacgctgggtcccacamacccccaagwcctaagcagctgcagcacggcgccattttgagagcccagccmccaccagactgcatcctgccctggggcccaacagcccctgcatctccacattcctggagccccastgacatnccccacccatggctgcagctgctggggcaraggcaggaaccactggcagcaancccwcccctgcccagcagaggggtggccatacaatttcatryacaccaaggacaaattcccctgmctgcaaatgctaccactgngagctgctgtggagctgaggyacgagcaatgcacncgctacccaggcgcctgcctatggctgctnccacwgaaagcaaccccaccctccccagcagcagggccacagtgcagccactgctgccctccacctgagcattccaccaggggcctggggatcaccctgcccctgcctaccacagccggcgcctgcacacaccaccggggggcctgaggacaggcctgcccggcccagctctgccacacccmccagtgcccaagcacgccatctaggggcctggggatcgcccaacccagtccaccaccgctggcacctgagcactcctcctgggggcctgaggacgggcctactcagcctgccactaccaccacagctggcacccacccacatgcgccacctgsrggcctggggactggcccgcccagcccgtcgcagccactgccaacaccaacacgcactgcttgggacccagagggttgtcccaccactgctactgccatcgcccatgccatgcyngctgcccaggggctcaagaacctgtccacccacccggcccaccgctgccactactggcacccaagcaagccacctggaggcccaagaatcggcctgcctggacccgctaacaccagtgccaatatatgccaccctggggcccaaggacaggcacactcagcccactantgccaccactggggcctgaagactggcccacctggcatcccagtccccagcaaaacttcaccacagcctccactaacaaccacaccctaagccactgaggaaatcacagacaccactgatgctgtttacagccaaagaaatcatacggagactacactactgcacgcacccagaatcaaagccaaagcgccctacccaaccaacaccatagatacatctwcaggaaaaagtccttccctacgaaagctamtccataaaattggaagaagcgactgttacaccagatgtgcagatatcaacgtaaggacacaagaaacatgaaaaagcaaggaaacatgacacctccaaaggaacacaataattctccagtaayagactccaawnaaaaagaaatctatgaaatcccmgawaaakaattcaaaatgatgatattaaagaagctcagtgagatacaagagaacwcagawaaacaatacaaggaaatcaggaaaacaattcakgatatgaatgagaaatttaccaaagagatagatatcataaaaaagaaccaaacagaaatcctggaactgaagaattcawtgaatgaaatamaaaatacatttgaaagcttcaanaatagactagatcaagcagaagaaagaatctcagaacttgaagacaggtcttttgaaataacccagtcagannnwaaaaaawaanaataaaaaagaatgaasaaagcctatgtgacatatgggacacmattaagcgaacaaatatttaaattwtgggwgttccagaagaagaagagntgggnaaaggcnyagaaaacctatttaataaaataatagctgaaaacttcccaggtttagcaagagattnagacatccagatacaggaggctcanagatccccaaatagatncaacgcnaaaagggcctctccamggcacattatagtcaaactgtcaaaagtcaaagacaaagaganaattctaaaaacagcaagagaraagcatctagtcacatataagggaatccccatcagactaacagtggatttctcagcagaaaccttacaggccaggagagaatgggatgacatattcaaagtgctgaaagaaaaagcaaaactgccagccaagaatactatacccagcaaagttatccttcaaaaatgaaggagaaataaagtctttcccagacaagcaaawamtgagggaattcgtcaccactagaccggccctacaagaaatgctcaagggagtcctamacctggaagcaaaaggacgatatctaccatcatgaaaacayacaaaagyataaaactcactggtagagcaawcacacaaakgagaaagagaaaggaatcaaatgktaccactacagaaawccaccaaaccacaaaganaaacaatgagaggaaacaaaagatatacaaaacaaccagaaaacaattaacaatatgacaggaacaagwcctcacatatcaataataaccttaaacgtaaatggattaaatttcccacttaaaagatanagactggct

SEQ ID NO: 62 - DNA, 3806 bp, Homo sapiens
  repeat_region (1)..(3806): l1m3_5
  misc_feature (28)..(28): n is a, c, g or t
  misc_feature (52)..(52): n is a, c, g or t
  misc_feature (118)..(119): n is a, c, g or t
  misc_feature (154)..(154): n is a, c, g or t
  misc_feature (269)..(269): n is a, c, g or t
  misc_feature (308)..(308): n is a, c, g or t
  misc_feature (326)..(326): n is a, c, g or t
  misc_feature (341)..(341): n is a, c, g or t
  misc_feature (374)..(374): n is a, c, g or t
  misc_feature (393)..(393): n is a, c, g or t
  misc_feature (466)..(467): n is a, c, g or t
  misc_feature (611)..(611): n is a, c, g or t
  misc_feature (637)..(637): n is a, c, g or t
  misc_feature (686)..(686): n is a, c, g or t
  misc_feature (719)..(719): n is a, c, g or t
  misc_feature (728)..(728): n is a, c, g or t
  misc_feature (774)..(775): n is a, c, g or t
  misc_feature (785)..(785): n is a, c, g or t
  misc_feature (843)..(843): n is a, c, g or t
  misc_feature (865)..(865): n is a, c, g or t
  misc_feature (881)..(881): n is a, c, g or t
  misc_feature (969)..(969): n is a, c, g or t
  misc_feature (985)..(985): n is a, c, g or t
  misc_feature (998)..(998): n is a, c, g or t
  misc_feature (1064)..(1064): n is a, c, g or t
  misc_feature (1094)..(1094): n is a, c, g or t
  misc_feature (1310)..(1310): n is a, c, g or t
  misc_feature (1332)..(1332): n is a, c, g or t
  misc_feature (1346)..(1346): n is a, c, g or t
  misc_feature (1360)..(1360): n is a, c, g or t
  misc_feature (1543)..(1543): n is a, c, g or t
  misc_feature (1755)..(1755): n is a, c, g or t
  misc_feature (1843)..(1843): n is a, c, g or t
  misc_feature (2203)..(2203): n is a, c, g or t
  misc_feature (2415)..(2415): n is a, c, g or t
  misc_feature (2444)..(2444): n is a, c, g or t
  misc_feature (2514)..(2514): n is a, c, g or t
  misc_feature (2557)..(2557): n is a, c, g or t
  misc_feature (2616)..(2616): n is a, c, g or t
  misc_feature (2634)..(2634): n is a, c, g or t
  misc_feature (2642)..(2642): n is a, c, g or t
  misc_feature (2752)..(2752): n is a, c, g or t
  misc_feature (2777)..(2777): n is a, c, g or t
  misc_feature (2788)..(2788): n is a, c, g or t
  misc_feature (2852)..(2852): n is a, c, g or t
  misc_feature (2861)..(2861): n is a, c, g or t
  misc_feature (2868)..(2868): n is a, c, g or t
  misc_feature (2874)..(2874): n is a, c, g or t
  misc_feature (2942)..(2942): n is a, c, g or t
  misc_feature (2975)..(2975): n is a, c, g or t
  misc_feature (2978)..(2978): n is a, c, g or t
  misc_feature (3014)..(3015): n is a, c, g or t
  misc_feature (3021)..(3021): n is a, c, g or t
  misc_feature (3032)..(3032): n is a, c, g or t
  misc_feature (3071)..(3071): n is a, c, g or t
  misc_feature (3084)..(3084): n is a, c, g or t
  misc_feature (3148)..(3148): n is a, c, g or t
  misc_feature (3155)..(3155): n is a, c, g or t
  misc_feature (3183)..(3184): n is a, c, g or t
  misc_feature (3192)..(3192): n is a, c, g or t
  misc_feature (3224)..(3224): n is a, c, g or t
  misc_feature (3263)..(3263): n is a, c, g or t
  misc_feature (3269)..(3270): n is a, c, g or t
  misc_feature (3282)..(3282): n is a, c, g or t
  misc_feature (3285)..(3285): n is a, c, g or t
  misc_feature (3295)..(3295): n is a, c, g or t
  misc_feature (3357)..(3357): n is a, c, g or t
  misc_feature (3460)..(3460): n is a, c, g or t
  misc_feature (3511)..(3511): n is a, c, g or t
  misc_feature (3624)..(3624): n is a, c, g or t
  misc_feature (3695)..(3695): n is a, c, g or t
  misc_feature (3715)..(3715): n is a, c, g or t
  misc_feature (3740)..(3740): n is a, c, g or t
agagcaagatggcagaacagaatgctcnaacaattgcccccatyctryyccnccacaggaacaccaaattgaacaactatctacacaaaawagcaccttcataagaaccaaaaatcanntaagcgatcacagtacctggttttaacttcatatnactgaaagaggcactgaagagggtaggaaagacagtcttgaatcgccaacgccgcccctcccccatcccccggcagtggccgcacggcacggagagagaatccgcgcacttgggngagggagagcgcagcgattgtgggactttgcgttggaantcagtgctgccctgtcanagcggaaagcaacancgggcagaactcagccggcgctcatagagggancatttagaccagccctagncagaggggaatcacccatcccagcggtcggaacctaagttccggcaagcctcgccaccgtgggctaaagtgcnntagggtcctaaataaacttgaaaggcagtctaggccacaaggactgcaattcctgggcaagtcctggtgctgtgccgagctaagagtcagtggacttagggggcacacgacctagtgagacacyagccggggtggccaagggantgcttgcgccacccyctcccycaacnccaggcagcacaactcgcagctccgggagagactccttccctccgcttnaggagaggagagggaagagtaaagaggactttntcttgcaantcggataccagctcagccatagtaggatagggcaccgagcagagtnnwgaggycccnattctaggccctagctcccggatgacatttctaaacacaccctgggccagaagggaanctgctgccttaaagggaagganccagtcctagcaggantcatcacctgctgactaaagagcccttgggccctgaataatcagcagcgatacccaggttagyactcgccgtaggccttgggtgagantctgagacgtgctggnttcaggtgtgacncagcacattcccagctgtggtggctacggggagagactccttctgcttgagaaaaggagagggaanagtaaaggggactttgtcttgcagcttagntaccagcttggccacagtggagtagagcaccaagcgggctcttagggtccccgattccaggccttggctgttggatggcatttctggacctgccctgggccagaggagagcccactgccctgaagggagagtctcaggcctggcagcattcaccgcaagctgacagaagagtccttgggctttaagtgaacattkgcgrtagycaggcagtacttnctgtgggcctgcggcggtggtngccatagggagagnctcctctgcttgtngaaaggggagggaagagtgggaagaactttgtcttgtggcttgagtgccagctcagccgcagtagaacagagcaccgggtagatttctaaggtttccgactccaggccctggctcctggatagcatcyctggacgtgcccggggccagagagaactcaccaccctgaagggaaggatacaagnctggctggctttaccacctgctgattgtagagtcccggggccttgagcgaacataagcagcggccaggcagtggttactgcgggccttgggcgagacccagtgctgtgctggcttcaggtctgaccyagtacagtcycagtgrtggtggccacaggggtgcttgtgtcacccctccyccagctccaggcagctcagcacagagagagagacngagtttgtttgrgggaaagtaarggaagagaacaagagtctctgcctggtaatccagrgaattcttccagatcttatccaagaccacnaaggcagtacctctacgagtctgcaagagccacagtattactgggcttggggtgccccctaatgcagatacggccgcagtgacaaaaaacttagatcacaacacycaagtcccttcaaatacctggaaagcyttcccaagaaggacgggtacaaacaagcccagactgtgaagactacaataaatacctaactcttcaatgcccagacacagacaaacatctacaagcatcaacaccatccaggaaaacatgacctcaccaaatgaactaaataaggcaccagggaccaatcccggagaracagagatatgtgacctttcagacagagaattcaaaatagctgttttgaggaaactcaangaaattcaagataacacagasaaggaattcagaatyctatcagataaatttaacaaagagattgaaataattaaaaagaatcaagcagaaattctggagctgaaaaatgcaattgacatactgaagaatgcatcagagtytcttaacagcagaattgatcargcagaagaaagaattagtgagcttgaagacaggctatttgaaaatacgcngycagaggagacaaaagaaaaaagaaaanaatgaagcatgcctacaagatctagaaaatagcctcaaaagggcaaatctaagagttagtgaccttaaanaggaggtagagagagagataggggtraaagtttattcaaagcnataataacagagaatgtcccaaacctagagaaagatatcaatattcaagtaaaagaagnttatagaataccaagcanatttaacncaaagaagactacctcaagacatttawtaatcaaactcccaaaggtcaaggataaagaaaggatcctaaaagcagcaagagaaaagaaacaaataacatacaatggagcnccgatatagtctggcagcagacttntcggcggaaancttacaggccaggagagagcggcatgacatatttaaagtgctgaagaaaaaaaaaaaaactttnatcctagantagcgtntccagngaaaatatccttcaaacatgaargagaaataaagactttcccagacaaacaaaagctgagggatttcntcaacaccagacctgtcctacaagaaatgctanagngaattcttcaatgtgaaagaaaaggacgttaatgannaataanaaatyatctgnaggtrcaaaactcactgataatagtgcgcagaaaaacanaatattataacantgtaattatggtgtataaactactcttragtagaaagactaaaagatgaaccaatcaaaaatantaactanaacaacttttcaagacatagacagtacnntaagatanaaatagaaacaacaaaaagtttaaaaattggnggacgaagttaaaatgtagagtttttattagttttcttnttgttnnttgrtttttttnaanttatgtaatnagtgttattatcagtttaaaatataggatattatttgcaagcctcatggtaacctcaaatcnaaaaacatacaacggatacacaaaaataaaaagcaagaaattaaaacatatcaccagagaaaatcaccttcactaaaaggaagacaggaaggaaggaaagaanaaagagaagaccacaaaacaaccagaaaacaaataasaaaatggcaggagnaagtcattacttatcaataataacattgaatgtaaatggactaaactctccaatcaaaagacatagagtggctgaatggatataaaaataagacccaatgatcggtcgcctanawgwaacacacttcacctataaagacacakatagactgaaaataaagggatgaaaaaagatatttcatgcnaatggaaaccaaaaaagagnaggagtagctatacttayatcaganaaaatatatttcaagacgaaaactataagaagagacaaagaaggtcactatataatgataaaggag

SEQ ID NO: 63 - DNA, 1765 bp, Homo sapiens
  repeat_region (1)..(1765): l1m3a_5
  misc_feature: n is a, c, g or t
  misc_feature (135)..(135): n is a, c, g or t
  misc_feature (138)..(138): n is a, c, g or t
  misc_feature (145)..(145): n is a, c, g or t
  misc_feature (234)..(234): n is a, c, g or t
  misc_feature (340)..(340): n is a, c, g or t
  misc_feature (377)..(377): n is a, c, g or t
  misc_feature (421)..(421): n is a, c, g or t
  misc_feature (563)..(563): n is a, c, g or t
  misc_feature (622)..(622): n is a, c, g or t
  misc_feature (817)..(817): n is a, c, g or t
  misc_feature (935)..(935): n is a, c, g or t
  misc_feature (945)..(945): n is a, c, g or t
  misc_feature (963)..(965): n is a, c, g or t
  misc_feature (1009)..(1009): n is a, c, g or t
  misc_feature (1017)..(1017): n is a, c, g or t
  misc_feature (1119)..(1119): n is a, c, g or t
  misc_feature (1659)..(1659): n is a, c, g or t
gagtgawgtcagcaagatggcagaatwggaggtctcaggctccagtctccctcacagaaagtccgactagcaactattcacagacaagaacgcctttgtgaaaaatgccagaacttggaaatgagrctgagacanctncgtggancacagaaacgaataaaaaccacattaaaagggtaagaggaaccgtctcactttaaccacgttgcccctmagtcggcacagtrccacacngagagaawttccccgggcctacagtttctacagtgggaaaagagagctkgaggtggacatccagcttccctagcattccaagatgcttcccaggargcccactcynatctcacctcatgaggaaacactgagggaaatggcanggctagaccgtctggagtcaggtagaaacaaaaaaagggggcanagctcatagtaaccagtgcacggatcttggtggtagctctgtattcctgccagcggtggcgcctgatcagaggtaccagccaatggcatagcccacccgcaaagctgagctggtcgctcccagaagcacggtgagaagttcnacccggcttgagtccctagatggccagcctccaaacccagccttagascctaccccagngctccacccaggcagggagatacacaccacmatgtatttcagcagagcacagaggctagacctgcctgacccaggagcccaaacagtgactcggcccagcctcaaagcccaccccaaggacccacacaggcaggaaggcaaacgcggattgtgcakctctaccagggcaaagtgccagccaccgtccattcstwncagcaattccatctaaccttgcagcctaggggctggccctgcccaactgcagagctsaaacagcggctccgcctggccasagagtmtaccccgtggcycagcccaatagacgcgactncaacgtccantcagcggctccgcctaannncagagcccagccagcagccccgcctgacctcagagcmcaggcantagcccgnccagctagagaacccaamagcaagcactgcctacccatggttattaccagctgtcccatccagaatcacaagctggactgaataatgaaggtctwttcctgncgaagaacacctgtaaaagccagaagaggtggctgcctmgtcaaatgcatggataccaatgcaaggacgcaagggttacgaagaatcaaagaatcatgacacctccaaaataaactaacaaagctccaacaatggamcctaaagaaataaagatctataaaatgactggcaaagaattcagaataatcctcttaaagaagttcggtgagctacaagaatacatagatagaaaattaaataaaatttggaaaacaatacatgaamaaaacgaaaagtttgacaaagaaatagaaacgawtattctaaaacccaaatagaaatcctagagatgaagaacacaattgctgaacaaaaaaattcaataaaaagcttcgacagcagactcaatcaagcagaagaaagaatcagtgagctcgaagacagaacatttgaaattatccagtmagaggatcaaaaataaaaaaaatgaaaaacagtgaagaaagcctataggaattatgggacaccatcaagaaaactaacatacgcataatagaaatnccagaaggagaagagaaagaaggccagaaagyatattttaagaaataatgactgaaaacttcccaaatctggggaaagatgccagcatccaggtacaagaagcaca

SEQ ID NO: 64 - DNA, 1175 bp, Homo sapiens
  repeat_region (1)..(1175): l1m3b_5
  misc_feature (164)..(164): n is a, c, g or t
  misc_feature (308)..(308): n is a, c, g or t
  misc_feature (358)..(358): n is a, c, g or t
  misc_feature (439)..(439): n is a, c, g or t
  misc_feature (467)..(467): n is a, c, g or t
  misc_feature (485)..(485): n is a, c, g or t
  misc_feature (695)..(695): n is a, c, g or t
  misc_feature (1033)..(1033): n is a, c, g or t
ggagtgagaacagcaagatggcagaataggaggtcccccactcatattccctcacagcaacaataatttggcagtcatccacgaacaaaagtgcctttgtgggagctttgggatccaggtaggaggttgcgaaacccwggtggagcccaagaccaaggaggacnatttgagaaggcaggcctgtgaccagatggcaggcttgctgatcatggtcttggctacagacccagaaacaktgctgtmcccctgtggactcagctacagcccyaattggccttggtcctgccaccmrmamcatmctccaaganacccaggaggagccatacccacccatgcctcgggtaacaggcccgccaanctcggtcctggctgtggaycctgaagcggcccatgacccagctccatcccctctcagmtgtggtcaggagccagtcctgcncgcccagggacccgcccagtgacctggnaagagcattcccagggantcagcaggagccacacccacacatatacctggtawcaggtctaccacgtgcagaaccaactgcagatcctgaagcagccctgtaactcagttccagctctacccaaccaaggttctgaatgtagtcctgcctatccaaagattcggcaagaggcatacccatccgtgctactggaggcaggcttgccaacctcagtctsactgtggatcntgaagyagcagccatgtgacccggctccaaccccaytyaactgcgatcccagtggmaatctcatcagcccagggatctracaggagaaggtcttcctcccaaaaccagtctgtaawgactgaaagaggtgtttgytccttcaaatgcacggacatcaacataaggctacacagatwataaagaatcaggcaaacatrmcaccaccaaaggaaactaawaaagttccagtaaccaaccccaaagaaacggagatctawaaattacctgacaaagaattcaaaataatcatcttaaagaakctcaatgagatgcaagagaacacagatakacaactaaanaaaatcaggaaaacaatkcatgaacaaaatgagaagtttaacaaagaaatagaaaccataaaaaagaaccaaatagaaatcctggarctgaagaatacaatgaaagaaataaaaaattctatagaaagctttaacaggagac

SEQ ID NO: 65 - DNA, 1625 bp, Homo sapiens
  repeat_region (1)..(1625): l1m3c_5
  misc_feature (424)..(424): n is a, c, g or t
  misc_feature (801)..(801): n is a, c, g or t
  misc_feature (1079)..(1079): n is a, c, g or t
gagtgatgtcagcaagatggcagaataggaggtctcagccctatccccccacagaaacaccgattttgacgaatacmcacggatgagagtacctttgwgggagtccgggagtccagtggacaagttccagcacaccgttggagwaaaaaatctaagaatagatgcattgaagagggtaagaagaacagtttcactttacccacgtcacccctcccccaaggtggcatagctcagtgccaagagagwctcctttggtccgcgatttctcccgcaggggaaagtgagagcatagtgagtgagcgtccggctcccccagccatgcgggacgctgcccaggaggcccacttttttctcaccccacccagaacactgaggkgatcggcatggctgagtggttgggagaggctgaaagcagggaagagangmtggggactcacagcagccagggcatggaactcaacmaaaggccacagatcctactaactgcttcgcggactccatcaggaagcccgcccacaagcttcwtgggatacgttgcctgcagacccccccagctggcccacgggcgcccccaacgctctgtatgcctcacccctggcttcggcatggctcccaagtgcactcctgtggacagcgagtgcaagcctctgcagatggcttacgagcacgcgcagacagccggcttgactctgcwgwattggaagaagstacacaaacttgagcatttcagggcaccgccctaggaaaaagaaacggaagcctctttgcactcggcctggctttgcaggattgagagaaganatacaatcttatctgcacctagcmtggctttgtgggattgagagaaggcatacaatcctaagacttacctcctcctcargagggaacaagaggwgtggagtgggyacatcmatagaaaaggtctgagagagycccagaatccctagccaggctggttggtgaaggtctttctcttctgaagccagtcagtaaagactggaggaggtgactgtttcttcaaatgtgaagacagcaatgcaagactttaagaaacatgaaaaatcaaggaaacatgacantaccaaaggaacataataattttccagtaaccgaccctaaagaaatggagatctacaaattgcctggcaaataattcaaaataatcgttttaaggaagctcagtgagctacaagaaaacacagatagacaactcaacaaaatcaggaaaacaatacatgaacaaaatgagaagttcgacaaagatatagaaatcgtaaaaaagaaccaaacagaaattctggagctgaagaatacaatgactgaacaaaaaaatgcaatagagagcwtcaacagcagactcgatcaagcagaagaaagaatcagcgagctcaaagacaggtcatttgaaattatccagtcagaggatcaaaaaaaaaaaaaatgaaaaagagtgaagaaagcctgtgggatttatgggacaccatcaagagaaccaatatacgcatcatggaaatcccagaaggagaagagagagagaaaggggcagaaagcttatttaaagaaataataactgaaaacttcccaaatctggggagagatatggacatccaggtacaagaagcaca

SEQ ID NO: 66 - DNA, 1375 bp, Homo sapiens
  repeat_region (1)..(1375): l1m3d_5
  misc_feature (435)..(435): n is a, c, g or t
  misc_feature (462)..(462): n is a, c, g or t
  misc_feature (479)..(479): n is a, c, g or t
  misc_feature (506)..(506): n is a, c, g or t
  misc_feature (613)..(613): n is a, c, g or t
  misc_feature (618)..(618): n is a, c, g or t
  misc_feature (620)..(620): n is a, c, g or t
  misc_feature (630)..(630): n is a, c, g or t
  misc_feature (658)..(658): n is a, c, g or t
  misc_feature (689)..(689): n is a, c, g or t
  misc_feature (830)..(830): n is a, c, g or t
  misc_feature (893)..(893): n is a, c, g or t
  misc_feature (927)..(927): n is a, c, g or t
  misc_feature (1142)..(1142): n is a, c, g or t
  misc_feature (1239)..(1239): n is a, c, g or t
  misc_feature (1247)..(1247): n is a, c, g or t
  misc_feature (1286)..(1286): n is a, c, g or t
  misc_feature (1292)..(1292): n is a, c, g or t
  misc_feature (1302)..(1302): n is a, c, g or t
  misc_feature (1364)..(1364): n is a, c, g or t
gagtgacatcagcaagatggcataataggaagccctggacctttcttcccttcacagacacactgattcagcaacaattcacggaaaattacctttgtgagaaatgcagaaactagttgagaggctcctgcaccctgggcgagcgcgaaaccagacccacatcaaagccggtagggagattcaggacaccctctcatcgaagtccctccccccggcwcagcgcmgtgcgatcggaaggaaaaaacccccaactcccggcttctcccaggggaggaaaagagttggttcgcacgtcaagtgccccracttttccgaggggctacccagaggactgtcttctgtcttgccwgtctcrgagctctgataggcccggcataatctagacacccgggggagaacagagatggtggtttgggctggtagatgccatagctnctcacccctgctcagcacagaacaagnagatgaaaacccccagntctcagctttcccctgaggaggaaaanagttgaatggactggaaaacagaattgaatggagcatccaacaatccagctttctgggagtgcctaaggaaccgattgcatttcaacttgtcgcgctacgctgatangattnancataccctanatgctcggcgactgcaaagaacaaaaancaggttggactagtacgaaggtttgagaggnccccaaaatctctggctaggctgatcggtgaaggtcttctcctgcataaggccagtctgtgaagactgagagaggtggctgctttgtataatgcgcagacaccaatacagagagtcaaggaaaataaagaatcagggaaanatgttccaaacaaaggaacaggataattttccagaaactgaccctaataaattggagttatanaatttacctgacgaagaattcaaaacaattgttntaaagatgctcatgaataacatgataaagatgctcaccaagatcaggaaaacaatacatgaacaaagtgagaatttcaacaaagagatagaaaatgttaaaaagtaccaaacaaaaatcatggagctgaagaatacaataactgaactgaaaaattcactagagaggttcaacagcagactagatcaagcagaagaaaggatcagtgaactcaangacaggtcattcgaaattatcgagtcagaggagcaaaaagaaaaaagaatgaaaaagagtgaagaaagcctaagggatttatgggacaccatcaagngaaccaanatacacatcatggaagtcccggaaggagaagagagaganaaaggnccagaaagcntattcgaagaaatagtgactgaaaacttcccaaatctggggaaagaaatggacatccagatncaagaagccca

SEQ ID NO: 67 - DNA, 600 bp, Homo sapiens
  repeat_region (1)..(600): l1m3de_5
  misc_feature (384)..(384): n is a, c, g or t
  misc_feature (597)..(597): n is a, c, g or t
gcacacttttccagcwgctgcctgagggtctggcttctaactagcctgcatctgggagctgatagggcagataaacaatagacctccaggagcctgaacaggaggttggcacttcccatgccttctccccagctcactccagtgataaatccaggtctacagattctccctggaaggagtttgtccacacatcaagcgccccaacttttatagcttccacccaagggactggctcctaaatcacctagctctgggagttgatggggctttgcatttatgagtctccctagaccacagagaacaaagaggtggttttaaaacaggcacacttccagcagctatctccccaggatcagagggtgcagcctgaacatgagtacaggnatttgccacagatcctctccctggcttagtgcagagagagtgggagataaacacccatgctcagcttcaccstgaagatagaagaaactggaacatacatccaacaccctaacctttccagctacatctagagagtctggtttctaccttacctgtctyagagtactracaggatatggcacatcctaatctccagggggccaccaaaaacanaga

SEQ ID NO: 68 - DNA, 750 bp, Homo sapiens
  repeat_region (1)..(750): l1m3e_5
  misc_feature (10)..(10): n is a, c, g or t
  misc_feature (192)..(192): n is a, c, g or t
  misc_feature (198)..(198): n is a, c, g or t
  misc_feature (235)..(235): n is a, c, g or t
  misc_feature (240)..(240): n is a, c, g or t
  misc_feature (255)..(255): n is a, c, g or t
  misc_feature (527)..(527): n is a, c, g or t
  misc_feature (617)..(617): n is a, c, g or t
  misc_feature (680)..(680): n is a, c, g or t
gagtgatgtnaccaaaggtagaatagaagcaagctggcttcactccccccacccacagaaaaccaaaaacaaatatacagcaccaagattatcaccagcaatatcccagaactcaaatatgaggatgagacagttcctgaggccacagagaagtaaaaaactctgagcagayagtaagagaattagacttcnatatcnacratgcccctcccccaatctgcccagcaccacatanaaaanttctcccagactcanagtttctacaytggaaaaagtgagattraggtggacaaccagcttccccaccatcttgggttccttggcaggagacctgtccctgcctcaacccatrggaagcatcaygagtgcctgaagggagaaatatycctgaggacagccagagacaaagggaggaggtaggactaccatccccagccctggaaactcggggggctgctctgtaacttggmcaaaggagacaccaaatcagagtggctgttcagcagcaccatgctgtaggaggttcnttccacaggtcccctggrcatgaacccctagccagccttcccacactgccaggatatcccctttgggacctcccccaatccgggatgggnagcactctgagagccaaggcaaacctrggcttaaggtgccatctagtgcygaaaggaggcagngacctagygaaaagaaattcaacaggtaaattacaaagaatctctaagcaaacaaaacaaaccagmcaga

SEQ ID NO: 69 - DNA, 1165 bp, Homo sapiens
  repeat_region (1)..(1165): l1m5_5
  misc_feature (94)..(95): n is a, c, g or t
  misc_feature (237)..(237): n is a, c, g or t
  misc_feature (336)..(336): n is a, c, g or t
  misc_feature (479)..(479): n is a, c, g or t
  misc_feature (544)..(544): n is a, c, g or t
  misc_feature (593)..(593): n is a, c, g or t
  misc_feature (597)..(598): n is a, c, g or t
  misc_feature (791)..(791): n is a, c, g or t
  misc_feature (793)..(794): n is a, c, g or t
  misc_feature (796)..(796): n is a, c, g or t
  misc_feature (1026)..(1026): n is a, c, g or t
  misc_feature (1031)..(1032): n is a, c, g or t
  misc_feature (1034)..(1034): n is a, c, g or t
aaagagtttcacttctagaatggcagtgtgaggagctccatagacccactccccagtgaaacaaccataactggtgaaaattatttttaaaaanncaaccatttaaagtctctggaaattgtcctaagggcatacagcaaatgaaacatttattcaagaaaatctactaaatcttagtaagaacagtgagagtctgtggtatttgagccatgactgtctcccttcttcccccccccnasccagctcagcawgatagaaactccactccaggtkggtgcagccaagaacacagggctccctctcccctcagctcccagtcaagggctatggtatctncctaggaggagcaggacatcagcatttctcatcccccccagctccatgttgcagaggctaaattccaggtgagtgtagctgagaggtcgggggctcccttcctccacccagcccccactcataggatggacttggctctaccngccaggtatggcaggctgagaatactggggccctaattacccttaccccagctcgctcatagggnagaggttccatgccaggagaggcaagccaagaagaccagaggctactrncccnncccagcacccagagcagtggctcagagattttgcccagggggagaggcaggccataagaacagagagctccaaagctctccccaaaggaactgactttatttgcaacagagtgtgaggaagttcaagcctaagggcactctcaaaaacaatggagattttggtggtaagcaattaagggaggctggtagctcnannanagyaacaagctaaaccataggccagctagtttaccagagagaaccagggaaagagacagctaagaagagccctcctggggtcagaacaaacctcaaacactgacctcaaaaaactacccctgcctraatttaattggatcagactgtggagcaatttatgccccagggattgttgaaaaacaatagagcaatcagccagcaattagtggagcctaacagctgggtgtgantacmnamngaggcagacagcttaacagagagatcagagaaagagacagtcaaagagagccctgctaaaaccactgtcatcccagggtgactgtgcacatgcccaaggctgtgccctctgaggagcaacatcagaggctt

SEQ ID NO: 70 - DNA, 2113 bp, Homo sapiens
  repeat_region (1)..(2113): l1m6_5
  misc_feature (214)..(214): n is a, c, g or t
gacatcagcaagatggcggaataggactttccagcgctcgtcctcacagaaacatcaatttgaacaactatccacgcacgaaaataccttcacaagagctaaggaaaccaggtgagagattacagyacctgggtgtagcacagaaataagaaaagacgcattgaagagggtaggaaggacagttttacattacccgcgtcacccctcccccaancccaggcagcacagcatggagagagataccctctgcttgggggaaggagagggaagtgagcacaggactttgccttggaccccaaacactaggcccgccccagtaaaacccagtactaggcaggcccccatagccccagactccaggccagtacctacggactgagccgyaccagatcccacagcccaggctccaggcctgcctggtggactcagtctccaggcctgccccagcaccaggccaaccccagtgccccaggctccagaccggccccagcaccaggccagccccagtagccccaggctccaggctgsccccagcaccaggctggcccccatagccccaggcttcaggcccaccccagcaccaggctggcccctrcagccctagtcatcaggccagcacctatagacccagcctccaggctggcccctgtagacacaggctccaggcctacccagcrccaggccagcccctgtagccccaggctccaggcccaccccaggytccagaccagcccagagccaggtyggcccacatagccccaggcttcaggcctgccccagyaccaggtcagcacccctggcctcagaccttagccaggtaccaggctggcacctgtagacacaggctccaggcctgcccagtaccaggccagtccctgtggccccaccctccagggcyagcccctgtggccccatgctccagcagacccagggttcaggcctgtcccagtagaccccagcactaggctagtccccatagacccaggctccaggactgtccctgtgtacccaggtcccagggcagcccctatggccccaggacccaggccagccctcagagacctagcctctaggccagccctgcagacccagcctccaggctggcacccayagacccaagctccaggccatcccccaggttccaggccagcctcagtagctccaggcaccaggctagcacccacagacccaggctccagactagccccacgctaccccagcaccaggccagccccaggctccaggctggtccctgtggcccaggctccagtggacccagggtccaggcctgctccagcagacccagggtccaggcccaccccagtagaccctggttccaggctagcccccatggactcaggctccaggaccacccctgcagacccaggctccaggccagccccyatggaccaggatccarggcccatytccccagttgcaggctccaggcctgccccagtgccaggccagcccccatggactcaggctccaggcccatcccagtggacccaggctccaggcccatcccagyaccaggccagcccctgyagactcaggctcaaggcccaccccagcaccaggtcagcccctgtggacccaggcttcaggccagcccctatagacacaggctccaggccyaccctcatggacccaggctccaggcccayccccacagacccaatcaacaggtccacccagtggatccaggctccaggcycaaccctgtggacccaggcaccaggcctgccacctgctgacccaggcaccaggccagcctgcctaaggactccagcagcaagcctgcctatagaccataccagatggcctgcccagaatctctggatgactggtgaagggctttcccagacaaagccagtctgcaaagactggaataagtccctacttcttcaaatgtgcagacaccaatgcaaggcccaagaatcawgaacaatcagggaaacatgacaccaccaaaggaacaaaataaatttccagtaactgaccctaaagaaatggagatctatgaactgcctgacaaagaattcaaaataattgttttaaggaagctcagtgaactwcaagaaaacacagatagacaattaaatgaaatcag

SEQ ID NO: 71 - DNA, 587 bp, Homo sapiens
  repeat_region (1)..(587): l1m7_5
tgcaaggtgaaatgaaaggacactagacagtaacttgaagccgtatgaagaaataaagatctcagtaaaggtaaatacatgggcaattataaaagctagtattattgtaacwatggtttgtaactccactttttgttttctacatgatttaaragactaatacattttttaaaaattattagtctaaaagctagtattattgtaattttggtttgtaactccattttgttttctacataatttaaaagactaatacattaaaaataattattaatttatgtttttgggcacacaatgtataaagatgtaattttgtgacatcaataactgaaaggggtggggayagagctgtaaaggcagagtttttgtatgttattgaagttaagttggtataaattcaaattagattgttataactttaggatgttaaatgtaatccccatggtaaccacaaagaaaatagctatagaatatacacaaaaggaaatgagaagggaattaaaatatttcactacaaaaaaaatcaactaaacacaaaagaagacagtaatggaggaaatgagggacaaaaaagctataaggcatat

SEQ ID NO: 72 - DNA, 1069 bp, Homo sapiens
  repeat_region (1)..(1069): l1ma10
  misc_feature (984)..(984): n is a, c, g or t
ttaatatccaaaatatataaggaactcaaacaactcaacaagaaraaaacaaataacccaattaaaaaatgggcaaargacctgaatagacatttytcaaaagaagacatacaaatggccaacagatatatgaaaaaatgctcaacatcactaatcatcaaggaaatgcaaattaaaaccacaatgagatatcacctcacacctgttagaatggctattatcaaaaagacagaaaataataaatgttggygaggatgtggagaaaagggaactattgtacactgttggtgggaatgtaaattagtayagccaytatggaaaacagtatggaggttcctcaaaaaaytaaaaataraactaccatatgatycagcaatcccactwctgggtatatatccaaargaattgaaatcagtatgtygaagagatayctgcactcccatgtttaytgcagcaytattcacaatagccaagatatggaawcaacctaagtgtccatcaayggawgaatggataaagaaaatgtggtatatatacacaatggaatactattcagccataaaaaagaatgaaatcctgtcatttgyarcaacatggatgaacctggaggacattatgctaagtgaaataagccaggcacagaaagacaaatactgcatgattccacttatatgaggtatctaaaatagtcaaactcatagaagcagagagtagaatggtggttgccaggggctgggggragggggaaatggggagttgctgttcaatgggtataaagtttcagttatgcaagatgaataagttctagagatctgctgtacaacattgtgcctatagttaataatactggattgtacacttaaaawttgttaaaagrgtagatctcatgttaagtgttcttatcgcacaacaaaaaaatggggaacttttggrrgtgatggatatgttcattatcttgattgtggtgatggtwtcacgggtgtntacatatgtcaaaactcatcaaattgtacacwttaaatatatgcagtttttagtgtataattatacctcaacaaagctgttttaa

SEQ ID NO: 73 - DNA, 1055 bp, Homo sapiens
  repeat_region (1)..(1055): l1ma2
  misc_feature (754)..(754): n is a, c, g or t
  misc_feature (769)..(769): n is a, c, g or t
ytaatatccagaatmtataaggaactcaaacaaatcaacaagaaaaaaacaaataatccmattaaaaartgggcaaaagacatgaayagacatttctcaaaagaagacatacaaatggccaacargyatatgaaaaaatgctcaacatcactaatcatcagagaaatgcaaatcaaaacyacaatgagatatcatctcaccccagttaraatggcttttattaaaaagacaaaaaataacaratgctggygaggatgtggagaaaagggaactcttayayactgttggtgggaatgtaaattagtacarccaytatggaaaacagtttggagrttyctcaaaaaactaaaaatagarctaccatatratccagcaatcccactrctgggtatatayccaaaagaaaggaaatcagtatatyaaaragatacctgcactcccatgtttattgcagcactattcacaatagchaagatttggaatcaacctaagtgtccatcaacrgatgaatggataaagaaaatgtggtacatatacacaatggagtactattcagccataaaaaagaatgaratcytgtcatttgcagcaacatggatggaactggaggtcattatgttaagtgaaataagycargmacaraaagacaaacaytgcatgttctcacttatttgtgggatctaaaaatcaaaacaattgaactcatggagatagagagtagaaggatggttaccagaggctgggaagggtagtnggaggattggggggnggkgrrgagggatggttaatgggtacaaaaaaatagttagaaagaatgaataagacctagtatttgatagcacaacaaggtgactatagtcaataataatttaattgtacattttaaaataactaaaagagtataattggattgtttgtaacacaaaggataaatgcttgaggggatggataccccattttccatgatgtgattattacacattgcgtgcctgtatcaaaacatctcatgtaccccataaatatatacacctactatgtacccacaaaaattaaaa

SEQ ID NO: 74 - DNA, 1042 bp, Homo sapiens
  repeat_region (1)..(1042): l1ma5
ttaatatccaaaatatataaggaactcaaacaactcaacaagaaraaaacaaataacccaattaaaaaatgggcaaargacctgaatagacatttytcaaaagaagacatacaaatggccaacagatatatgaaaaaatgctcaacatcactaatcatcaaggaaatgcaaattaaaaccacaatgagatatcacctcacacctgttagaatggctattatcaaaaagacagaaaataataaatgttggygaggatgtggagaaaagggaactattgtacactgttggtgggaatgtaaattagtayagccaytatggaaaacagtatggaggttcctcaaaaaaytaaaaataraactaccatatgatycagcaatcccactwctgggtatatatccaaargaattgaaatcagtatgtygaagagatayctgcactcccatgtttaytgcagcaytattcacaatagccaagatatggaawcaacctaagtgtccatcaayggawgaatggataaagaaaatgtggtatatatacacaatggaatactattcagccataaaaaagaatgaaatcctgtcatttgyarcaacatggatgaacctggaggacattatgctaagtgaaataagccaggcacagaaagacaaataccgcatgttctcactcatatgtggaagctaaaaaagttgatctcatagaagtagagagtagaatagtggttactagaggctgggaagggtagggrgaggggggratagggagaggttggttaawggrtacaaaattacagttagataggaggaataagttctagtgttctgtagcaccgtagggtgactatagttaacaayaatttattgtatattttcaaatagctagaagagaggattttgaatgttcccaacacaaagaaatgataaatgtttgaggtgatggatatgctaattaccctgatttgatcattacacawtgtatacatgtatcgaaatatcacactgtaccccataaatatgtacaattattatgtgtcaattaaaaa

SEQ ID NO: 75 - DNA, 1053 bp, Homo sapiens
  repeat_region (1)..(1053): l1ma9
  misc_feature (903)..(903): n is a, c, g or t
ttaatatccaaaatatataaggaactcaaacaactcaacaagaaraaaacaaataacccaattaaaaaatgggcaaargacctgaatagacatttytcaaaagaagacatacaaatggccaacagatatatgaaaaaatgctcaacatcactaatcatcaaggaaatgcaaattaaaaccacaatgagatatcacctcacacctgttagaatggctattatcaaaaagacagaaaataataaatgttggygaggatgtggagaaaagggaactattgtacactgttggtgggaatgtaaattagtayagccaytatggaaaacagtatggaggttcctcaaaaaaytaaaaataraactaccatatgatycagcaatcccactwctgggtatatatccaaargaattgaaatcagtatgtygaagagatayctgcactcccatgtttaytgcagcaytattcacaatagccaagatatggaawcaacctaagtgtccatcaayggawgaatggataaagaaaatgtggtatatatacacaatggaatactattcagccataaaaaagaatgaaatcctgtcatttgyarcaacatggatgaacctggaggacattatgctaagtgaaataagccaggcacagaaagacaaatactgcatgatctcacttatatgtggaatctaaaaaagtcaaaytcatagaaacagagagtagaatggtggttaccaggggctggggrakgggggaaatgggaagatgttggtcaaagggtacaaagttkcagttatgtargatgaataagttctrgagayctaatgtacagcatggtgactatagttaataatactgtattgtatacttgaaatttgctaagagagtagatyttaagtgttctcaccacanacaaatggtaactatgtgaggtgatggatatgttaattagcttgaytgtggtaatcatttcacaatgtatacatatatcaaaacatcacgttgtacaccttaaatatatacaatttttatttgtcaattatacctcaataaagctgraaa

SEQ ID NO: 76 - DNA, 932 bp, Homo sapiens
  repeat_region (1)..(932): l1mb3
ttaatatccaaaatatataaggaactcaaacaactcaacaagaaraaaacaaataacccaattaaaaaatgggcaaargacctgaatagacatttytcaaaagaagacatacaaatggccaacagatatatgaaaaaatgctcaacatcactaatcatcaaggaaatgcaaattaaaaccacaatgagatatcacctcacacctgttagaatggctattatcaaaaagacagaaaataataaatgttggygaggatgtggagaaaagggaactattgtacactgttggtgggaatgtaaattagtayagccaytatggaaaacagtatggaggttcctcaaaaaaytaaaaataraactaccatatgatycagcaatcccactwctgggtatatatccaaargaattgaaatcagtatgtygaagagatayctgcactcccatgtttaytgcagcaytattcacaatagccaagatatggaawcaacctaagtgtccatcaayggawgaatggataaagaaaatgtggtatatatacacaatggaatactattcagccataaaaaagaatgaaatcctgtcatttgyarcaacatggatgaacctggaggacattatgctaagtgaaataagccaggcacagaaagacaaatactgtatgattccacttatatgaggtacctagagtagtcaaattcatagagacagaaagtagaatggtggttgccaggggctggggggaggggggaatggggagttaktgtttaatgggtacagagtttcagtttgggaagatgaaaaagttctggagatggatggtggtgatggttgcacaacaatgtgaatgtacttaacgccactgaactgtacgcttaaaaatggttaaaatggtaaattttatgttatgtatattttaccacaattaaaaaaaaa

SEQ ID NO: 77 - DNA, 1711 bp, Homo sapiens
  repeat_region (1)..(1711): l1mb6_5
  misc_feature (213)..(213): n is a, c, g or t
  misc_feature (327)..(327): n is a, c, g or t
  misc_feature (580)..(580): n is a, c, g or t
  misc_feature (878)..(878): n is a, c, g or t
  misc_feature (965)..(965): n is a, c, g or t
  misc_feature (1224)..(1224): n is a, c, g or t
  misc_feature (1232)..(1232): n is a, c, g or t
  misc_feature (1307)..(1307): n is a, c, g or t
ggtaatgtcagcgaaaatggcggagtaaggamctccgaaaattcactcctccataaaagcaatgaaaacactggcaaaaattgtcagaatcaactttttcagaactctggaaattaaccaaaggcttacagcaatctaggaagtgtttattcaagaaaaayagctgaatctcwgtaagaacagcgagctttgtggtattttaacttgccctantcccatcccccwctctccagctcagcagtagccttgaaaataacagcttatattatggtgaaaaccagcagccaccggagkgggcagaacgggtttggagcttctcaaaagycncattcccagggaattgtcattatttgacctgtctggcggctccctggaagactccattcamagggcttgtctttatttgacctgactcagagctcactcagtgcgaamagcattatacctgggggcatttgttgaaaacawttagaggcaawtgtttaacaccacagctgcctgaggcagtgrataacagttggggcaaacaagaggctgaccaaaaagcttaaaaggaaaagctggggaatgagatgtccgnaggggctttgaaaagctccaacatattcctgggaatctagaaggccacgcgcatgcccagggctgtacacatgctcagaaaagacctaagaaggccctaagctctcacctctggctgaccttgagactctgcacaagcaggaagtgaagactaaggcagagttgtaaactgcctggctgagtgttgaaggtatgccccaacacacacacagaaccccttggcaaagamtgggagacttgttggttcmaggcatttaaggaaatctctgtccaatcattagctgaccactaagctaacngagcagagacttcagtggccacacatgacaaagaatacagactttacaaaattagttcagaaaagtcactaaacaaacagcaacaanaacacaaaagagyaacaacaaaccctggaaaggagggagaatctgatttccagagttgccacattatattatttaaaatgtccagttttcaacaaaaaattacgaggcatacaaagaaacaagaaagtatggcccatacacaggaaaaaaagcagttaatagaaactatccctgaggaagcccagacgttggacttactagacaaagactttaaatcagctattwtaaatatgttcaaagaactaaaggaaaccatgtntaaagaantaaagaaaaatatragaacgatgtctcaccaaatagagaatatcaataaagagacaaaaattataaaaaataaancaaatagaaattctggagttgaaaagtacaataactgaaataaaaagttcactagaggggtacaacagcagatttgagcwggcagaagaaagaatcagcgaacttaaagataggtcaatcgagattattcagtctgaggaacaaagaaaaaagaatgaagaaaaatgaasagagcctcagagacctgtgggacaccatcaagcgtaccaatatatgcataatgggaatcccagaaggagaagagagaaarkggcagaaagaatatttaaagraatagtggccgaaaatttcccaaatttgatgaaaaacatywayctwcayatccaagaagctcaataamctccaagtaggataaactcaaagagatccacatttasatgcatcatagtcaaactgctgaaaaa

SEQ ID NO: 78 - DNA, 922 bp, Homo sapiens
  repeat_region (1)..(922): l1mb7
cttgtatccagaatatataaagaactcttacaactcaacaataaaaaaacaaacaacccaattaaaaaatgggcaaaagatttgaatagacatttctccaaagaagatatacaaatggccaataagcacatgaaaagatgctcaacatcattagtcattagggaaatgcaaatcaaaaccacaatgagataccacttcacacccactaggatggctataattaaaaagacagacaataacaagtrttggcgaggatgtggagaaattrgaaccctcatacattgctggtgggaatgtaaaatggtgcagccactttggaaaayagtttggcagttcctcaaaaagttaaacatagaattaccatatgacccagcaattcyactcctaggtatatacccaagagaawtgaaaacatatgtccacacaaaaacttgtacacgaatgttcatagcagcattattcataatagccaaaaagtggaaacaacccaaatgtccatcaactgatgaatggataaacaaaatgtggtatatccatacaatggaatattattcagccataaaaaggaatgaagtactgatacatgctacaacatggatgaacctcgaaaacattatgctaagtgaaagaagccagacacaaaaggycacatattgtatgattccatttatatgaaatgtccagaataggcaaatccatagagacagaaagtagattagtggttgccaggggctgggggraaggggaaatggggagtgactgctaatgggtacggggtttctttttggggtgatgaaaatgttctaaaattagatagtggtgatggttgcacaactytgtgaatatactaaaaaccactgaattgtacactttaaaagggtgaattttatggtatgtgaattatatctcaataaarctataa

SEQ ID NO: 79 - DNA, 1077 bp, Homo sapiens
  repeat_region (1)..(1077)
  misc_feature (690)..(690): n is a, c, g or t
  misc_feature (725)..(725): n is a, c, g or t
  misc_feature (765)..(765): n is a, c, g or t
cttgtatccagaatatataaagaactcttaaaactcaacaataaaaaaacaaacaacccaattaaaaaatgggcaaaagatctgaatagacatctcaccaaagaagatatacagatggcaaataagcacatgaaaagatgctcaacatcatatgtcattagggaaatgcaaattaaaacaacaatgagataccactacacacctattagaatggctaaaatccaaaacactgacaacaccaaatgttggcgaggatgtggagcaacaggaactctcattcattgctggtgggaatgcaaaatggtacagccactttggaagacagtttggcagtttcttayaaarctaaacatactcttaccatatgatccagcaatcayactccttggtatttacccaaatgaattgaaaacttatgtccacacaaaaacctgcacacgaatgtttatagcagctttattcataattgccaaaacttggaaacaaccaagatgtccttcaataggtgaatggataaacaaactgtggtacatccatacaatggaatattattcagcgataaaaagaaatgaactatcgagacatgaaaagacatggaggaaccttaaatgcatattgctaagtgaaagaagccagtctgaaaaggctacatactgtatgattccaactatatgacattctgaaaaaggnaaaactatggagacaagtaaaaagatcagwgattnctagagkgastrggarrgggagggaagaataggtggagcncaggggatttttagggcagcgaaactattctgtatgatactataatggtggatacatgacattatacatttgtcaaaayccatagaactgtacaayacaaagagtgaaccctaatgtaaactatggactttagttaataataatgtatcaatgttggttcatcaattgtaacaaatgtaccacattaatgcaagatgttaataatagggtaaactrttgtgtgggggagggagtatatgggaactctctgtactttctgctcaatttttctgtaaacctaaaactgytctaaaaaataaagtctattaataa

SEQ ID NO: 80 - DNA, 2487 bp, Homo sapiens
  repeat_region (1)..(2487): l1mc3
  misc_feature (848)..(848): n is a, c, g or t
  misc_feature (1194)..(1195): n is a, c, g or t
  misc_feature (1789)..(1790): n is a, c, g or t
  misc_feature (1827)..(1827): n is a, c, g or t
  misc_feature (2380)..(2380): n is a, c, g or t
cttgtatccagaatatataaagaactcttaaaactcaacaataaaaaaacaaacaacccaattaaaaaatgggcaaaagatctgaatagacatctcaccaaagaagatatacagatggcaaataagcacatgaaaagatgctcaacatcatatgtcattagggaaatgcaaattaaaacaacaatgagataccactacacacctattagaatggctaaaatcaaaaacactgacaacaccaaatgttggcgaggatgtggagcaacaggaactctcattcattgctggtgggaatgcaaaatggtacagccactttggaagacagtttggcagtttcttayaaarctaaacatacaattaccatatgatccagcaatcayactcctaggtatttacccaagtgaattgaaaacwtatgtccacacaaaaacctgcacacgaatgtttatagcagctttattcataattgccaaaacttggaaacaaccaagatgtccttcaataggtgaatggataaacaaactgtggtacatccatacaatggaatattattcagcgataaaaaggaatgaactactgakacatgaaaagacatggatgaatctyaaatgcatattgctaagtgaaagaagccagtctgaaaaggctacatactgtacgattccatttatatgacattytggaaaaggcaaaactatagagacagaaaacagattagtggttkccagrggttgagagatgggaagtggggatgrytgcaaargtaaagcacargggattttttagggtgrtaaaactattctgtataaactattctgtatgatactatggtggtggatacacgacantatgcatttgtcaaaacccacagaacttgtcaaaacccacagaactttacagcataaagagtgaactttaatgtatgyaaattttaaaaaatcatttargagatcgggggatcycaggatggaatacagamtgtgacaaaagaatctaactgtattacaaatgtatgaaacaacctcactgaagggratgggggaaaaaggtgctgacctaagtaactttggaaatgagtggagtctgtaagactaaaggcaaaaggaactgcacataagcactgtactctagttrataaagttgtttyccayaggggtayaggttaacaattctgawacyactatatacgtatannaraattaaacaaataagtaaatgtatkgtagatgatgggagccaggtttctcactgtcggagtgaggagttacagataagcaaagggaggagrctagaatgaaccctgtggtattrgattagaattggaggtatcagtatgaactcatgrtttttaatatayryryryryryryrtttcctagttctgtccgctgagagggcctagaagcaacgacaccccagtagcaatgagcacacctagcacccagatcttggtttctaataccattctccaataaaaggaaccagggctccttggagaaatggctgattctaggactagggcaggaaatatacaagatgagcctggaacatcttgcartgccagaaaataaggaagtgctcaaaaacacaatgatrggggtatgtcaaagggacacagragccaactgaaagagctcccaatggccaaagctggaacaatttgagcaacaaaataaattatrgtagtattggattataacycaaagtataaaataaatatccatgagtccatactgatataaatgaatgattaaataaataaataaattgagaagataaataagtctctnntgcagaagaatttcaaataatttatgtagatarcctnccctcaaggaagtggagcgtaactccccactccttaagtgtgggatggatatagtgacttccttccagaaagcatagtataggacggaaaaaaaagtaaatttacwgtagagaaacctgacaaacactaccttagccaggtaatcaaagttagcatcaacaattgtaagtcatgttgatagyatatacccttgatatgatgtgataagaatggcacttcacctccgtggtcttcctcccaaaaacccataaccccagtctaatcatragaaaaatatcagacaaattccaactgagggacattctacaaaatacctgaccagtactcctcaaaactgtcaaggtcatcaaaaacaaggaaagtctgagaaactgtcacagccaagaggagcctaaggagacatgacaactaaatgtaatgtggtatcctggatgggatcctggaacagaaaaaggacattaggtaaaaactaaggaaatctgaataaagtatggactttagttaataataatgtatcaatattggtttattagttgtgacaaatgtaccatantaatgtaagatgttaayaataggggaaactggatgtggggtatatgggaactctctgtactatttttgcaactttcctgtaaatctaaaactatttcaaaataaaat

SEQ ID NO: 81 - DNA, 2724 bp, Homo sapiens
  repeat_region (1)..(2724): l1mc4
  misc_feature (848)..(848): n is a, c, g or t
  misc_feature (1870)..(1870): n is a, c, g or t
  misc_feature (2054)..(2054): n is a, c, g or t
  misc_feature (2541)..(2541): n is a, c, g or t
  misc_feature (2586)..(2587): n is a, c, g or t
cttgtatccagaatatataaagaactcttaaaactcaacaataaaaaaacaaacaacccaattaaaaaatgggcaaaagatctgaatagacatctcaccaaagaagatatacagatggcaaataagcacatgaaaagatgctcaacatcatatgtcattagggaaatgcaaattaaaacaacaatgagataccactacacacctattagaatggctaaaatcaaaaacactgacaacaccaaatgttggcgaggatgtggagcaacaggaactctcattcattgctggtgggaatgcaaaatggtacagccactttggaagacagtttggcagtttcttayaaarctaaacatacaattaccatatgatccagcaatcayactcctaggtatttacccaagtgaattgaaaacwtatgtccacacaaaaacctgcacacgaatgtttatagcagctttattcataattgccaaaacttggaaacaaccaagatgtccttcaataggtgaatggataaacaaactgtggtacatccatacaatggaatattattcagcgataaaaaggaatgaactactgakacatgaaaagacatggatgaatctyaaatgcatattgctaagtgaaagaagccagtctgaaaaggctacatactgtacgattccatttatatgacattytggaaaaggcaaaactatagagacagaaaacagattagtggttkccagrggttgagagatgggaagtggggatgrytgcaaargtaaagcacargggattttttagggtgrtaaaactattctgtataaactattctgtatgatactatggtggtggatacacgacantatgcatttgtcaaaacccacagaacttgtcaaaacccacagaactttacagcataaagagtgaactttaatgtatgyaaattttaaaaaatcatttargagatcgggggatcycaggatggaatacagamtgtgacaaaagaatctaactgtattacaaatgtatgaaacaacctcactgaagggratgggggaaaaaggtgctgacctaagtaactttggaaatgagtggagtctgtaagactaaaggcaaaaggaactgcacataagcactgtactctagttrataaagttgtttyccayaggggtayaggttaacaattctgaaactattttatatgtattgtaggattgagcaaataagtaaacgcattgaagataatgggagccaggtttctcactgtcggagaagggagttacaaatatggaatgggggaagrctagaatgaaccctgtggtattrgattagaattggaggtatcagtatgaactcatgrtttttaatatayryryryryryryrtttcctagttctgtccactgagagggcctagaagcaatgacaccccagtagcaatgagcacacctagcgcccagatcttggtttctaaataccattctccactaaaaggaaccagggctccttggagaaatggctgattctaggactagggcaggaaatgtacaagatgagcctggaacatcttgctrtgccagaaaataaggaagtgctcaaaaaatgatrggggtatgtcaaaaggacacagragccagcttgaaggggctcccactggccaaatctgggacaatttgagcatcaaaataaataacggtagtaatggattataactcattgaataaaataaatatccatgagttcatactaatataaataaatgaataaaagaaataaataaataagaragaaaggaaagytcttcttacagtagaatgccaactaayaaatgtagaaggaataaaataatagaaaaatcaccatttggcaaayaccacagtaataantgtttcaggcaagaaccatcgatagatgctaaaattagtgggcgaaartttgatgagaaacgggatatttgcatagtctcaaagtatctcyccacaagatatttattaattayaaagggaaaaatagtractttacagtagagaaacctggcagacaccaccttaaccaagtgatcaaagttancatcaccaataatgagacaaattgacatcatgcgcytcctgatgtgatgcgccgagaaggacacaacatcacttctgtgatattcytgccaaaaatgcataacctgaatctaatcatragaaaatatcagacaaacccaaattgagggacattctacaaaataactggcctgtactcttcaaaaatgtcaaggtcatgaaagacaaggaaagactgaggaactgttycagattgacggaagactagagacatgacaactaaatgcaacgcgtgatcctggattggatcctggatcgagaaacggtgggagtttktayctataaaggacattattgggacaattggcgaaatttgaataaggtctgtagattagataatagtattgtatcaatgttaatttcctgattttgataattgtactgtggttatgtaagagaatgtccttgtttttaggaaatacacactgaagtatttaggggtaaarggncatsatgtctgcaacttactctcaaatggttcagraaaaaaaatnnatatayataaryagagaatgataaagcaaatgcggcaaaatgttaacaattggtgaatctgggtgaagggtatacgggwgttctttgtactattcttgcaacttttctgtaagtttgaaattatttcaaaataaaaa

SEQ ID NO: 82 - DNA, 460 bp, Homo sapiens
  repeat_region (1)..(460): mer88
  misc_feature (51)..(51): n is a, c, g or t
  misc_feature (244)..(246): n is a, c, g or t
  misc_feature (267)..(267): n is a, c, g or t
  misc_feature (272)..(272): n is a, c, g or t
  misc_feature (331)..(331): n is a, c, g or t
  misc_feature (366)..(367): n is a, c, g or t
  misc_feature (374)..(374): n is a, c, g or t
  misc_feature (400)..(400): n is a, c, g or t
  misc_feature (440)..(440): n is a, c, g or t
cactgtattgtaaattttaaaaacttcmtattttcctgatgcctcaacatncccacaaacaggctgtgagcaccccgcccaggcgaccaggtgcaccagtgtaataaggctggtccctgctacaagttccccttcttgccttcccctgactgtgacccagtgacattcaaacgcaccagtgaaatccccttacgccttktgcttgtgtsctccaccctgacccccagkaaaggcacttgcccgnnngttctctctctccctgcctcntaccngcttggttgagcccgctccctgggcactcctcccatccggccccctgcatggcatggcntgcctccctctctaggacctgtgagtataataaannctttaanttacgtctctctgagtgcaatttctntggccgtgctggagtgatccttaaagaccccaccagaggnacttccccgtttacaacaca

SEQ ID NO: 83 - DNA, 559 bp, Homo sapiens
  repeat_region (1)..(559): mer89
  misc_feature (177)..(177): n is a, c, g or t
tgagagactgaatatacaaacggacaatggccagaccatatatgaaaatagaactctgacccacaacctctgcagcaacctgcccaggaaaccaatccccttatctacaattacaacaaasaaggcagcctgctgtaagtcagacttgcasaaagtcagattgctctctctagtaancagyccaggaagccaaacaacaacctctgcaacaattggcccmaaatggccaggacttgatcaataactgmcagcttccctaatttttgtccctgcttccaacttaggaccaaccagagaaagcyaaatatgcwccccwaaccaatcacataggatgccctgcttctagttagcccgcctmcagcttccccatgccaacaacctccaatcagggcatacctgaagtcttcccttttttccactataaagctttcccactcctctgcctgcctttgagtctctgccaaacgcaagtgatggtggctgactcccttgctatagcaagctctgaataaatagcctttgcttgttctcatttggktggtcttcatttatttccaca

SEQ ID NO: 84 - DNA, 510 bp, Homo sapiens
  repeat_region (1)..(510): mer9
  misc_feature (97)..(97): n is a, c, g or t
tgttgggaacaggcccccccaaatctggccataaactggccccaaaactggccataaacaaaatctctgcagcactgtgacatgttcatgatggccntaacgcccacgctggaaggttgtgggtttactggaatgaggacaaggaacacctggcccacccaggtcggaaaaccgcttaaaggcgttcttaaaccatgaacaatagcatgagcaatctgtgccttaagggcatgttcctgctgcagataactagccagacccaccccttcatttcggcccatcccttcttttcccataagggatacttttagttaatcgagtatctatagaaacaatgctaatgactggcttgctgttaataaatacatgggtaatctctgtttggggctctcagctctgaaggctgtgaggccctgatttcccactttacacctctatatttctgtgtgtgtgtctttaattcctctagtgccactgggttaggctgtccccagtcgagctggtctcgca

SEQ ID NO: 85 - DNA, 615 bp, Homo sapiens
  repeat_region (1)..(615): mer90
  misc_feature (49)..(49): n is a, c, g or t
tgagaaagagaaaagcagcccctgacatctgagagctggcctggtaccnwcagctaggccttggtgttgctgggagctggcctggcactcacagctaggccttggtgttctcctgttgaacataaacaatttcacagaatatcaacatcagacaaggccactctgtgaccatgatggatcgagacaaaaacaagaccactccgtaatcatgtctgaacacagacaaaaacatgaacattgtccaagccacaaaaatgaccaagcatccccctctcccggctaatatgagtgactgctgcttctttaccaattacagctttagcctcgctctagtcttccctccttctagataagatttattaagatacccaatcacagaattactcccgcttcctgacagcatccaatccagagcaaagcttcgcttccttaaaccctcccccaaatcacctaacacaagcccaaatcctataataagtcctttctaacatcctcttactgagacgccccgtggttccccatggtgtgcgttctccctcgctgcarcgagcaataaacccaacttgttcaaccacaggtgtgttcctggtggtctttggctggagggcactgaca

SEQ ID NO: 86 - DNA, 196 bp, Homo sapiens
  repeat_region (1)..(196): mer91a
  misc_feature (187)..(187): n is a, c, g or t
cagggctgccatgtacagttgtgcaggttgtgcactgcacaagggcgcctggccgagggagcgagtgggggctgaaatccagcccgtgctccgctcgccaagccgtgmgtcctggtgtggggctgcgtctacctagaggaaggggcgcctttttctaattcacacaaaggcgccgtatgggctagcnctggccctg

SEQ ID NO: 87 - DNA, 184 bp, Homo sapiens
  repeat_region (1)..(184): mer91b
  misc_feature (175)..(175): n is a, c, g or t
cagggctgccatgtacagttgtgcaggttgtgcactgcacaactctagggggcgccattcacatcatagacatcacagatttgtataatgacaattttccaacagatggcagtaaagtgtcttgaggaaggggcgcctttttctaattcacacaaaggcgccgtatgggctagcnctggccctg

SEQ ID NO: 88 - DNA, 140 bp, Homo sapiens
  repeat_region (1)..(140): mer91c
cagggctgccatgtacagttgtgcaggttgtgcactgcacaactctagggggcgccattcacatcatagatctatgatgtgaatggcgccccctagagttgtgcagtgcacaacctgcacaactgtacatggcagccctg

SEQ ID NO: 89 - DNA, 412 bp, Homo sapiens
  repeat_region (1)..(412): mer92a
  misc_feature (38)..(38): n is a, c, g or t
  misc_feature (207)..(207): n is a, c, g or t
  misc_feature (218)..(218): n is a, c, g or t
  misc_feature (225)..(225): n is a, c, g or t
tgaccaagtgttcacagttgttcgcttcttaccctctncttcgccttgacagaactttagtcaggcttctctccttcctacaggcccctgaactttgcttgcccctaagcctgagcaagcactmaaatgcagaacgtgccccccttakcagcttgtcctgagaatcggctgaccacagcgggacacatttcctgtcaaaccccaccnatcatgttgtntgctcgntccccctcgcttgcccactgtcycctttctactggttctgcttaycyctccctataaaagaaaagcctttttctgtttgattttgagacgcttgcaagttcctgaggtcggagcgttctccctattgcaatagtctttttgaataaagtctctccttatctaagtccggatttgtttttatttgaca

SEQ ID NO: 90 - DNA, 636 bp, Homo sapiens
  repeat_region (1)..(636): mer92b
  misc_feature: n is a, c, g or t
  misc_feature (144)..(144): n is a, c, g or t
  misc_feature (272)..(272): n is a, c, g or t
  misc_feature (350)..(350): n is a, c, g or t
tgacaatgttgaactttacctgagccctgtgctcctggaaaacagtgawggttaagaaatccccccatccttttgtgttccgggaaacggcttactgcaaagaaccatccttccccatatgacttagataagactcatggatgncccccttgtttacctatgacaaggccagacacagaccctccaaattcccattctttgcctcataaatgattagctgaactgtttgtccccactgatcaatckggacaaaatacctgytaactcgactngaccaaactttagttaagcttctctccttcctccaggmccctgaactttggaccaccctcagcctgagccagcatcanaatgtagaacagcccctcctgagaataggctgrcctcaaggtaaracattctctgatctactctgatctcgccaccctttcatcccactcccccacacctggttctttctagccttgtttactcctccctataaaagaaaagccctttctgcctgaactttgagatgcttgcagatcttatggtcagagcgttctccctattgcaatagtccccytccccccmttgcaatagtccttttgaataaagtctctccttagctaagtccggatttgtttttatttgaca

SEQ ID NO: 91 - DNA, 554 bp, Homo sapiens
  repeat_region (1)..(554): mer92c
  misc_feature (82)..(82): n is a, c, g or t
  misc_feature (141)..(141): n is a, c, g or t
  misc_feature (172)..(174): n is a, c, g or t
  misc_feature (185)..(185): n is a, c, g or t
  misc_feature (190)..(191): n is a, c, g or t
  misc_feature (302)..(302): n is a, c, g or t
  misc_feature (407)..(407): n is a, c, g or t
tgacaatgcwgaactttacctgagccctgtgctcccggaaaacagcgatggttaagaaatccccccatccttttgtgttccnagaaacggcttaccgcaaagaactacccttccctatatgacttaaataagactctctgncccttctttctcacgacttccataagatcannnatgattccttncctgnnaagaccaaacacagacctttccccttttgcctgaacccgctgacaaggccagacacggaccctccaacttcctattctttgtttcataaatgattagctgagattagaagngtctgtccccctgaaactagctagacacagagataaacatttcctgttcagctaaccgagacttcccctgattgcaaaacaaccccccctgtaaatctccccacntgaaacctatctaccccttcctataaaagtccaaggcaaaaccaccctgccgagacacttcatagtcttcggatcttggatgctctccctattgcaatagcctgaataaaatcatctccttamttgtctagtgcattttgtctttca

SEQ ID NO: 92 - DNA, 397 bp, Homo sapiens
  repeat_region (1)..(397): mer93
  misc_feature (88)..(88): n is a, c, g or t
  misc_feature (98)..(98): n is a, c, g or t
  misc_feature (109)..(109): n is a, c, g or t
  misc_feature (206)..(206): n is a, c, g or t
  misc_feature (213)..(213): n is a, c, g or t
  misc_feature (257)..(257): n is a, c, g or t
tgttaaaataattaawtgggaggccattagactgaggtggctctagcgccctgggttcctacgtaagcaaaccgaaacctaactcagncgtttcttanaaataactatnaagaraaaatgaaacttaagctyagccaatcacaarcsgccaactaacctctgattacataaccagggacttcccacctggacagtccaaatraggngactgcncaactgtaaccaatcaaatactttatttgctctgcttcctcatncaccytataaaagcctttccttcaagcccctccggcggagccccaaaccacccgtggtctggggctgcccgattcatgaatcactgtttgctcaaataaactctttaaaattttaatgtgcctcagtttatcttttaaca

SEQ ID NO: 93 - DNA, 134 bp, Homo sapiens
  repeat_region (1)..(134): mer94
tagggtgaccatataatttatcgtccaaaccgggacacttttgagagtgaaagggggcgctattaataattacgccaggacaacaggyataaaccaggactgtcccaggcaaaccgggacatatggtcacccta

SEQ ID NO: 94 - DNA, 431 bp, Homo sapiens
  repeat_region (1)..(431): mer95
  misc_feature (314)..(315): n is a, c, g or t
tgtttaagaaaataaaaatggaggccacagtttagatataccccaaggccaaccgcccatagccacgtaaccaaaatttaagtcatcctgatttccccaaaacgctagctctaatcataaacataacacaaaacgtaagctttacatccttgtcagcgtgattcagtgaaattaaaccaatcagctatagacaaatcagcttaaacagctctacttgccctaaaaagaatgttaatgtataacagccaatcacgaaaaaggtcaaaatacttcctcctttatgctttataaactgtgctatgactgccgtragnngagcttcttaccactttcrgyttgargtctcccggttcgcgarctgtwctttctctyattgtatgcacaataaactttaaaatttttcctaacttgatctgattttawttttgaca

SEQ ID NO: 95 - DNA, 175 bp, Homo sapiens
  repeat_region (1)..(175): mer 96
cagggccgggactagggtgaggcaagtgaggcgcctagggcgcaaaatttaaggaggcactcactctcagggtcgtgcaagtgcagggtcggcatttgcacgaccctgagagtgagtgcctccttaaattttgcgccctaggcgcctcacttgcctcaccctagtcctggccctg

SEQ ID NO: 96 - DNA, 434 bp, Homo sapiens
  repeat_region (1)..(434): mer96b
  misc_feature (5)..(5): n is a, c, g or t
  misc_feature (183)..(183): n is a, c, g or t
  misc_feature (214)..(214): n is a, c, g or t
  misc_feature (284)..(284): n is a, c, g or t
  misc_feature (297)..(297): n is a, c, g or t
  misc_feature (301)..(301): n is a, c, g or t
  misc_feature (323)..(323): n is a, c, g or t
  misc_feature (359)..(359): n is a, c, g or t
  misc_feature (399)..(399): n is a, c, g or t
  misc_feature (409)..(409): n is a, c, g or t
  misc_feature (431)..(431): n is a, c, g or t
aggancagggtgagrcaagtgaggcactcgccttgggtacaaaatttaagggggtgccaaaaaactcagtaatcaagataaataatattttaatgcaatattttttttaaaatcaaaattaatgaaaaaatccatgacaaaatgtcaaaatkttaaataaagatatkatcagtatgactgatntttcattttgcctcaggctccagtatgagtngacactgcacagttrctgatcctgtatttaaaattttgatattttgttcatcatggatttttttgcattnattttgatttttnaaantattacattaaatactatgtanctwtwtwatryattcagatattatttatcttgattnctgartgttttggtacctycttaaattttgcgccygaggnragtgcctcnctcgcctcaccctagttctggntct

SEQ ID NO: 97 - DNA, 1106 bp, Homo sapiens
  repeat_region (1)..(1106): mer97
caggcagtcctcgctttgcacggttccgatatgcatgaatttcagttaccacggtttagttaaataacaccagtcccccaacaacacggttcaaatttcagttaccacggtatattaactgtgagtaattgcataaagtacaaacttcgctgctagctcttcagtccacaaatcactacataaataacagatgcgcatcatgatcagtgaccaatcacatcacttctttcaaagtctgtcggtgattggtcactgtgcatctgttattcagttcatgcacagacagcaaagcgtgtagttgtgttgcctccttgtctcccagtgataaacccacgtgacattttacaaaaatggataatcgaaagagggaattggccaacaaagatgaaagtgcagcaaagaaacgaaaagtgataatgctggaagtgaaattcgaatcaaacgtaaatggagttatagaagaaatagctgaccgtgggaatgttgacactgccgccatttgagagactctagatatgcagccagaggaacttagtgaaggcgaacttatcgacataaatgaggaaagtggttgtgacgaaaaggatgaagatgtcccagaggaagtgacgccagcaaaaaacttcacattaaaggaactcttggagatatttcacgacattgaaagcgcaaaggataaaatgttggaagctgatccaaacttagaaaggagtatgacaatttgccaaggcatagaaaagatgcttactccgtatcgtaagttatataaagaagaagaaggcaagcactgttcaaactactcttgataagttttttttggtttgttttgataagtttttttacaaagaaataaaacactttaattctcaatgtttctaatgttttaaattatagtgtactaaataaatattagttttattatttttttcattccctatacatttataaccgacggtaagagagtttttaatgtttttgacaaaaatttttaaaggtcacggaacaattataattttcccattgattattaagatcgctttgcatggtttcagcttgcatggtcatttttacggtcccgtactaccgtgcaaagcgaggactgcctg

SEQ ID NO: 98 - DNA, 787 bp, Homo sapiens
  repeat_region (1)..(787): mer99
  misc_feature (16)..(16): n is a, c, g or t
  misc_feature (102)..(102): n is a, c, g or t
  misc_feature (105)..(106): n is a, c, g or t
  misc_feature (143)..(143): n is a, c, g or t
  misc_feature (159)..(159): n is a, c, g or t
  misc_feature (223)..(223): n is a, c, g or t
  misc_feature (228)..(228): n is a, c, g or t
  misc_feature (299)..(299): n is a, c, g or t
  misc_feature (305)..(305): n is a, c, g or t
  misc_feature (389)..(389): n is a, c, g or t
  misc_feature (402)..(402): n is a, c, g or t
  misc_feature (473)..(473): n is a, c, g or t
  misc_feature (515)..(515): n is a, c, g or t
  misc_feature (591)..(591): n is a, c, g or t
  misc_feature (617)..(617): n is a, c, g or t
  misc_feature (688)..(688): n is a, c, g or t
aartcagaattcctgnaarttctyagraattytccaartcataagttattcttaaamtaytwcygtctcaaaacaaaacaaaaaaattgtaacatycttcmnacnnyttaytcattatyatrgayatctaaaaatytgtttrnttaawaacraatattnagcttagtaggatttacaaaraaytayagyytataataaatattcaaacactgaaaaacashancaaanattattgggtagtattcaaataacattcagatctcctaacaaagttasgrgacaacactacacagagtcanatgtcnaaactgccaatttaaggacttattttgcttccaaaacyyattatttcttggaataccactcataggatttgtataaagtatacnatrcatataaacntattaatatttattttatttgcaagaatgattcaccattagcagyakacarggccatgaacacatasttanaatggcaacagctacaagcaaggctgactgattaattraatngtgccacttctctcttacgtgytcctgtcctggtttctrgaaataccraccttaaccttcaactccatgtgcymanrtttyctgctcytgctttcaacttgntgtcactggattccttcaaatcagtaatgtctctatgttgattgttaagttttaatttttcagagaataanattttttcttattttcccratttttyaactgatttttcttgggattcagragaaaaatttcttaagaaatgccaggaaggaattcccacttggaaacac

SEQ ID NO: 99 - DNA, 262 bp, Homo sapiens
  repeat_region (1)..(262): mir
acagyayagcatagtggttaagagcacggrctctggagccagactgcctgggttcgaatcccggctctgccacttactagctgtgtgaccttgggcaagttacttaacctctctgtgcctcagtttcctcatctgtaaaatggggataataatagtacctacctcatagggttgttgtgaggattaaatgagttaatayatgtaaagcgcttagaacagtgcctggcacatagtaagcgctcaataaatgttrgytattatt

SEQ ID NO: 100 - DNA, 374 bp, Homo sapiens
  repeat_region (1)..(374): mlt1a
tgctatggactgaatgtttgtgtccccccaaaattcatatgttgaagccctaatccccaatgtgatggtattaggaggtggggcctttgggaggtgattaggattagatgaggtcatgagggcggggccctcataatgggattagtgcccttataaaagagaccycagagagctcccttgccccttccgccatgtgaggacacagtgagaaggcgccgtctacgaaccagggaatgagccctcaccagaaactgaatctgccggcgccttgatcttggacttcccagcctccagaactgtgagaaataaatttctgttgtttaagctacccagtctatggtattttgttatagcagcccgaacagactaagaca

SEQ ID NO: 101 - DNA, 390 bp, Homo sapiens
  repeat_region (1)..(390): mlt1b
tgttatgggctgaattgtgtccccccaaaattcatatgttgaagtcctaacccccagtacctcagaatgtgactgtatttggagatagggtctttaaagaggtaattaagttaaaatgaggtcattagggtgggccctaatccaatatgactggtgtccttataagaagaggaaattwggacacagacacgcacagaggraagrccatgtgargacacagggagaaggcggccatctrcaagccaaggagagaggcctcagaagaaaccaaccctgccgrcaccttgatctcggacttcyagcctccagaactgtgagaaaataaatttctgttgtttaagccacccagtctgtggtactttgttacggcagccctagsaaactaataca

SEQ ID NO: 102 - DNA, 466 bp, Homo sapiens
  repeat_region (1)..(466): mlt1c
tgttatgggttgaattgtgtccccccaaaattgatatgttgaagtcctaacccctagtacctcagaatgtgaccttatttggaaatagggtcwttgcagatgtaattagttaagatgaggtcatactggagtagggtgggccctaaatccaatatgactggtgtccttataaraagaggaaatttggacacagacacgcacacggggagaaggccatgtgaagacggaggcagagattggagtgatgcakctacaagccaaggaacgccaargrytgccagcaaaccaccagaagctaggaagaggcaaggaacagattctccctcacagccytcagaggarrccagccctgccgacaccttsatctcggacttctggcctccagaactgtgagagaatamatttctgttgtttaagccacscagtttgtggtactttgttacggcagcccyaggaaactaataca

SEQ ID NO: 103 - DNA, 506 bp, Homo sapiens
  repeat_region (1)..(505): mlt1d
  misc_feature (238)..(239): n is a, c, g or t
tgtggtaggcwgaataatggctccccaaagatgtccacgtcctaatccccagaacctgtgaatatgttaccttacatggcaaaagggactttgcagatgtgattaagttaaggatcttgagatggggagattatcctggattatccgggtgggcccaatgtaatcacaagggtccttawaagagggaggcagagggtcagagtcagaagaaggagatgtgacgatggaagcagrragnngaaaactcaacgttgctggctttgaagatggaggaaggggccatgagccaaggaatgcgggcagcctctagaagctggaaaaggcaaggaaacggattctcccctagagcctccagaargaacgcggccctgccgacaccttgattttagcccagtgagacycattttggacttctgacctccagaactgtaagataataaatttgtgttgttttaagccactaagtttgtggtaatttgttacagcagcmayaggaaactaataca

SEQ ID NO: 104 - DNA, 568 bp, Homo sapiens
  repeat_region (1)..(568): mlt1e
  misc_feature (228)..(231): n is a, c, g or t
  misc_feature (233)..(234): n is a, c, g or t
  misc_feature (236)..(237): n is a, c, g or t
  misc_feature (258)..(259): n is a, c, g or t
  misc_feature (398)..(398): n is a, c, g or t
  misc_feature (433)..(433): n is a, c, g or t
tgtggtaggcagaattctaaratgmtcccaatgatcctcgcctcctggcgtaatctccttgagtgtgagtaggacctgtgacttgcttctagccaacggaatatggcaaaggtgatgaratrtcacgtgattacgcgtacgtgattatgtaasattcagtctttgmcgtcattcttgccgagagactctcctsctggtyttgaagaagtaagctgccacgtcatgagnnnncnnannagarygccgcaaggcaagggnntctagagctgagagtcgcccttactgatgggcagcaagaagcaagccacctcagtcctacagccgcaaagaactgaattctgccaacaacctagtgagcttggaagcagatcctgcccagtcgagcctccagatgagancgcagccctggctgacgccttgactgcagccttgntagaccttgagcagaggacccagctaagccgtgcccagactcctgacccacagaaactgtgagataataaatgtgtgttgttttaagccgctaagtttgtggtaatttgttacgcagcaatagaaaactaacaca

SEQ ID NO: 105 - DNA, 641 bp, Homo sapiens
  repeat_region (1)..(641): mlt1e1
  misc_feature (74)..(74): n is a, c, g or t
  misc_feature (369)..(369): n is a, c, g or t
  misc_feature (376)..(376): n is a, c, g or t
  misc_feature (380)..(380): n is a, c, g or t
  misc_feature (398)..(398): n is a, c, g or t
  misc_feature (447)..(447): n is a, c, g or t
  misc_feature (555)..(555): n is a, c, g or t
tggtaggcagaattctaagatggcccccaagattcycaccccctggtatcatatrccctgtataatcccctccncttgagtgtgggcaggatctgtgaatacgatgggatatcactcctgtgattaggttacattatatggcaaaggtgaagggattttgcagatgtaattaaggttcctaatcagttgactttgagttaatcaaaagggagattatcctgggtgggcctgacctaatcaggtgagccctttaaargaggytctagaagtcagacatggaagaagtcagagagattcaaagcagcagagatgctctcctgctggccttgaagaagcaagctgccatgttttgtggagagggccatatgncagggantggngagcagcctctaggagcngaagtcctcagtcctacaaccacaaggaaatgaattctgccaacaaccngartgagcttggaagaggatcytgagcctccagatgagaaygcagccccagctaacaccttgatttcagccttgtgagaccctgagcagaggacccagctaagctgtncccagattcctgacccatagaaactgtgagataataaatttgtgttgttttaagctgctaagtttgtggtaatttgttatgcagca

SEQ ID NO: 106 - DNA, 593 bp, Homo sapiens
  repeat_region (1)..(593): mlt1e2
  misc_feature (35)..(35): n is a, c, g or t
  misc_feature (97)..(97): n is a, c, g or t
tgccctaatcctggaacctatgaatacgttacatnacatagcaaaagggattttgcagatgtaattaaggttactaaccttaaaatagggagattancctggattatctgggtgggcctaatctaatcacatgagcccttaaaagcagagagttttctccggctgatagcaggaaatgtaaagcagaagaggaagtcagagagatttgaagcatgagaagrattcgatgtaccattgctggctttgaagatggagggggccacgatgcaagaaatggaagaggcctctaggagctgagagtggctcccagctgacagccagcaaggaaatggggacctcagtcctacaaccacaaggaactgaattctgccaacaacctgaatgagcttggaagtggattcttccccagagcctccagataagagcccagcctagctgacacctttgatttcagccttgtgagaccttaagcagagaacccagttaagcctacctggacttctgacctacagaactgtgagataataaatgggtgttgttttaagctgctaaatttgtggtaatttgttacacagcaatagaaaactaataca

SEQ ID NO: 107 - DNA, 541 bp, Homo sapiens
  repeat_region (1)..(541): mlt1f
  misc_feature (179)..(179): n is a, c, g or t
tgtggtagccagcctccaagatggcccccaatgatccctgctcctggtattcacayccttgtatggtcycytcctacattgaryyagggctrgtctgtgtgaccaatagaatagggcagaagtgatggcgtgtsacttccaagaytargtcayaaawaacactgtggyttctgcyttgntctcttcgggctactcactctgggggaagccagctgccatgctatgaagacactcaagcagcctatggagaagtccacgtggsaaggaactgaggtctcctgccaacagccagcttcgacytgccagccatgtgagtgagccatcttggaagcggatcctccagccccagtyaagccttcagatgactgcagccccggctgacatcttgactgcaacctcatgagagaccctgagccagaactacccagctaagctgctcctarattcctgacccacagaaactgtgagataataaatgtttrttgttttaagccactaagttttggggtaatttgttacgcagcaatagataactaataca

SEQ ID NO: 108 - DNA, 561 bp, Homo sapiens
  repeat_region (1)..(561): mlt1f1
  misc_feature (62)..(62): n is a, c, g or t
  misc_feature (165)..(165): n is a, c, g or t
tgtccacaaattctttgatactcctcttaagaggtggagtctaattcccctccccttgaatntgggctggacttagtgacttgcttctaaccaatagaatatggcagaagtgatggtatgtgacttctaaggctaggtcataaaaggcattgywgtagcttcctncttgctctctctctctctctctcttggatcactcactctgggggaagccagctgccatgtcatgaggacactcaagcagccctgtggagaggcccatgtggcaaggaactgaggcctcctgccaacagccagcaaggaactgaggcctcctgccaacagccatgtgagtgagccatcttggaagcagatcctccagccccagtcaagccttcagatgactgcagccccagctaacatcttgactgcaacctcatgagagaccctgagccagaaccacccagctaagctgctcctaaattcctgacccacagaaactgtgagagataataaatgtttgttgttttaagccactaagttttggggtaatttgttatgcagcaatagataactaataca

SEQ ID NO: 109 - DNA, 512 bp, Homo sapiens
  repeat_region (1)..(512): mlt1g
  misc_feature (66)..(66): n is a, c, g or t
  misc_feature (279)..(279): n is a, c, g or t
tgtggcggattttaaaaatggccacaaattctttgacactcttcccatcgaggagtggggtccgtntcctctccccttgaatctgggtgggctctgtgactgcttcgaccaatagaatrcggtggaagtgatgctrtgtgacttctgagsccaggtyataaaarrcattgcagcttcctgcttgctggaackctcacacttggagtcctgagccaccacgtaagaagttcarctrccccgaggccaccatgctgtgaggaagcccaagctastccacanagagaaaccgagccatcttgraagcggatcctccagccccagtyaagycttcagatgactgcagcyccggctggcgtcttgactgcgccgataccacgtgggacagagawgaactrcccagctaagcccagcccaaattgctgacctatagtattgrgaacgaataaatgrttattgttttaagccactaagttttggggtggtttgttacgcagcartagataactgaaaca

SEQ ID NO: 110 - DNA, 379 bp, Homo sapiens
  repeat_region (1)..(379): mlt1g1
  misc_feature (329)..(329): n is a, c, g or t
tgtggcagattgtattttccaaagatggccacaacaatatctcccatcccacatgctcttctttcaatgtgacctttgccacttcttccatcaagaggtggggtctatgtcccctccccttgaatctgggcagacctttgtgactgccttgaccaatagaatatggtagaagtgatgctgtgtgacttctgaggctaggtcataaaagtgccatgcacttctgccttgctcacttgggacactcactcttggaacccagccaccatgctgtgaggaagcccaagcagcccatggagagacccgtggagaggatctgaggttcctggtcnacagccccagctgagctcccagccaacagccagcatcaacttgccagcca

SEQ ID NO: 111 - DNA, 622 bp, Homo sapiens
  repeat_region (1)..(622): mlt1g2
  misc_feature (550)..(550): n is a, c, g or t
tgtggcagattgtattttccaaagatggccacaacaatatgtcccttccacatgctttcttcaatgtgactttgacactcttcccatcaagaggtaggggtctatgtcccctccccttgaatctgggtaggcttgtgactgcttctgaccaatagagtatggtagaagtgacactgtgtgacttctgaggctaggtcataaaaggcaatgcagcttctgcctgccttgttcgctggaacactcactcttggagccctgagccaccatgtaagaagtctgactaccctgaggctaccatgctgtgaggaagccaagccacatggagaggccatgtgtaggcattctgatcaacagccctagtgtttgagtcatcccagcccaggtgccagacatgtgagtgaagaagccttcagatgattccagcccccagccattgagtcacccccagccttcgaatcttcccagctgaggccccagacatcatggagcagagacaagccatccctactgtgccctgtctgaattcctgacccacagaatctgtgagaangcataataaaatggttgttttaagccactaagttttggggtgrtttgttacacagcaatagtaactggaaca

SEQ ID NO: 112 - DNA, 547 bp, Homo sapiens
  repeat_region (1)..(547): mlt1h
  misc_feature (9)..(9): n is a, c, g or t
  misc_feature (371)..(371): n is a, c, g or t
  misc_feature (224)..(224): n is a, c, g or t
tgtggtagntgattgcaaaaatgacmccattctccacccctccctgtatccatgccctttgcaatgtgactttgcagctcctcccatcaagaggcggagtctgtttccccaccccttgaatctgggctggccwtgtgacttgctttggccaatrgaatgckgcagaagtgacggtgtgccagttccgagcctaggcctcaagaggccttgcgtgcttccgctcnctctcttggaaccctgccaccgccatgwgaacaagcccgggctagcctgctggaggatgagagaccacgtggaggagagccgagscgccccagctgaggccatcctggacmggccagcccccagccaagatcagcagagccaccaantcaaccagcagctgaccacagatgcatgagggagcccagctgagaccagaagaaccgcccagctgagcccagcccaaattgccgacccgcagaatcgtgagctaaaataaatggttgttgttttaagccactaagttttggggtggtttgttatgcagcaatagctaactgataca

SEQ ID NO: 113 - DNA, 313 bp, Homo sapiens
  repeat_region (1)..(313): mlt1h1
  misc_feature (6)..(6): n is a, c, g or t
  misc_feature (39)..(39): n is a, c, g or t
  misc_feature (43)..(43): n is a, c, g or t
  misc_feature (46)..(46): n is a, c, g or t
  misc_feature (102)..(102): n is a, c, g or t
  misc_feature (172)..(172): n is a, c, g or t
  misc_feature (182)..(182): n is a, c, g or t
  misc_feature (196)..(196): n is a, c, g or t
tgagancaccatgcttgagaggccacgtgtaggagctcnagtnranagtcctagctgagcccagccttccagccatccctaccaaggtaccagacatgtgantaaagccatcttggattgtctaggccagcccakctgccagmtgaataccactgagtgaccccagtcaatnctayatggancagaagaatcaccnagctaagccctgcccaaattcctgacccacaaaatcatgaratataataaaatggttgttgttttaagcyactaagttttgggatacttttctacacatcaatagataactggaaca

SEQ ID NO: 114 - DNA, 314 bp, Homo sapiens
  repeat_region (1)..(314): mlt1i
tggccatgtgacttgctttggccaatgaaatgtgagcagaagtgacatgtgtcacttctaggtagaagcatttaagagccagtgcgtagattcgccatrattctctttccctctgccatgagaccacaatgttccagatggaggctgctccatcagcctgggtccctgagtgaggaatgacatggagcagagccccagctgacctacaatagacatgtaacatgagtaagaaataaacctttgttgttttaagccactgagatttgggggttatttgttactgcagcataacctagcctatcctgactgataca

SEQ ID NO: 115 - DNA, 516 bp, Homo sapiens
  repeat_region (1)..(516): mlt1j
tgtggcagagactgctagttgtcccccaatatccattctccccttcttccttagtaatagaamccccaatttttagctgggcacatggccacccagaaataaagactacatttcccagcctcccttgcagctaggtgtggccatgtgactttctaagttctggccaatgagatggtaagcagaagtgatgtgtgcaacttctaggaaatgtccttaaagagaggggcaygcccttcttttccccttcctccttcctgctgcctggaatgtagatgtgatggctggagctctagcagccatcttggaccatgaggtgaaagccacatgctaaggatggcagagcagcaagatagaaggagcctgggtccctgagactatggagcagagctgccataccagccctggactgcctacctctagacttctatatgagagagaaataaattctatcttgtttaagccactgttattttgggttttctgttacttgcagctaaacctaatcctaacayacca

SEQ ID NO: 116 - DNA, 435 bp, Homo sapiens
  repeat_region (1)..(435): mlt1j1
tggctagctgttcaccaaatctgtttccttttcttcctgggcacacagctagactacatttcccagcctcccttgcagcttaggtgtggccatgtgactgagttctagccaatggaatgtaagcagaagtgatgtgtgtcacttccaggcctggcccataaaacctcccatgccatcttcctctctattctctcttctsctgcatctgctggctggatgttaacacccagggtgaccttggaagccatatgttgaagatggcagagcctccatcagcctgggtccctgaatgactgtgtggagcagagcaccactcccacccccccatcatcaattggactttacatgagcaagaaataaacttctattgtgttaagccactgagattttgagggtttatttgttacagcagctagtgttaccttaactaataca

SEQ ID NO: 117 - DNA, 417 bp, Homo sapiens
  repeat_region (1)..(417): mlt1j2
  misc_feature (110)..(110): n is a, c, g or t
  misc_feature (328)..(328): n is a, c, g or t
tgtggcagagactggctaggtgttcaccaaacccatttccttttcctcctgggcacacagctagactacatttcccagcctcccttgcagttaggtgtggccatgtgacntgagttctggccaatggaatgtgggcagaagtgatgtatrccacttccaggcctggcccataaaaccctccaatayataatcctctctctctctttcttcmtcbrctggctggatgcagagaatccaaaggactccaaggatggtagagccacaagatggaaggagcctgggtccctgagtcactacttggaggagagccactcagcagaaacacccnaccagaaacccacactgaattgtaacatgagtgagaaataaacttttattgtgttaagccactgagatttgggggtttttgttacagca

SEQ ID NO: 118 - DNA, 476 bp, Homo sapiens
  repeat_region (1)..(476)
tgtggttctrgtggggctgactccaacccctagctccaggggtgggcacatgacccaggcctggccaatcagagcattccatcccyctggccacagtgattggttcagggatgggcatgtgacccaagctgggccaatgagagttctcaagccctgggacttttgctggaactattgggaaagagrtgttctttttctcctggggttgctaagctggtaggatgtaagcctggagctgctggtggtcatcttgccaccacrtggagagagcctgcctgagaatgaagccaacacagaggaaagcagagccaagagatggagagagacagattcctgatgacatcatttgagcacctggatccagccatgcctgaagccagatctatgctacccctggacttttcagttacatgagccaataaattctcttttttgcttaagcyagtttgagttgggtttcttgtcacttgyaacca

SEQ ID NO: 119 - DNA, 356 bp, Homo sapiens
  repeat_region (1)..(356): mlt1l
  misc_feature (120)..(120): n is a, c, g or t
  misc_feature (136)..(136): n is a, c, g or t
  misc_feature (159)..(159): n is a, c, g or t
  misc_feature (194)..(194): n is a, c, g or t
  misc_feature (273)..(273): n is a, c, g or t
tgaatcttgattggtctaagccaatcatggtaaatcctattccccttgccagtgattggtttaggaatgggcatgtgacacaattctggccaatgagacatgaggggaagtctgctgggngggcttctggaaaagnttttcttttttaattaaaaaatntaaagagaaaacatgtcctcttttcttgctcttgntttggatgttgttttgtgaggatgtgatgcttggagctgtggcagccatcttgcaaccatgaggcgacaagcctgagangraaagccaacacactgaggatggcagagcagaaagataaaaagaacctgggtccttgatgatatygttgagctgctgaatca

SEQ ID NO: 120 - DNA, 1338 bp, Homo sapiens
  repeat_region (1)..(1338): mlt1r
  misc_feature (533)..(533): n is a, c, g or t
  misc_feature (600)..(602): n is a, c, g or t
  misc_feature (625)..(625): n is a, c, g or t
  misc_feature (637)..(638): n is a, c, g or t
  misc_feature (642)..(642): n is a, c, g or t
  misc_feature (784)..(784): n is a, c, g or t
  misc_feature (803)..(803): n is a, c, g or t
  misc_feature (814)..(814): n is a, c, g or t
  misc_feature (1031)..(1031): n is a, c, g or t
  misc_feature (1129)..(1129): n is a, c, g or t
  misc_feature (1192)..(1192): n is a, c, g or t
gattttggcactaggaagtggggtgcttacgtaacaaatacctaaaaatgtggaagcgactttggaactgggtaataagtagaggctggaagagttttgaggtacatgytagaaaaagcctagatttccttgaagagactgttggtagaaatatggatattaaaggyaattctggtggggggctcagaaaggaagwggagagctatagagaaagctcccgtcgtcttagagaatacaaaaatcgtcatgaacagaatgttgctagaaatatgaatgttaaaggtgcttctggtgaggtctcagacggaaatgagggagatgttattgaaaattggaggaaaggtgatccttgttataaagtagcaaagaacttggctgaattgtgttcatgtcctagggctttatggaaagtagaacttgyaagtgatgaactkggatattcagctgaggaaatttctaagcaaagtgttgagggcgcaacctgacttctcctaactgcttatagtaaaatgtgagagacataaagatggaantgttgagtaaaaaggaaccagaacgtaaagatttggaaaattctcagcctgatcatgtaacagaaannncaatagcgttctctggaaagaanaccaaggatgtnnccgngcaaccgtttgctaaagagattagratcgtgactcgtgggtccaatcaaccatctcagcaraarccargaatagagatgrggttatttaggaaatatctgtggaggactctcttatctgatggctcgaacccctatgacttncataggagaccgacaaggnttttgagaatnttacaccagcagaaacactgccaacttggactraagggracagagacgagaaaaaatgaaggaagrgtggcagaccgaaggtggggctgtctcgtttcagagcatggkgtcaccccagcgggcccggaagatgaatctcaggactcagaggcattagcctccagccttaagatctaatgaagtttgccctgctgggttttggacttgcttgggaccngtgactcctttcttyyyttcyatttctcccttttggaatgggaatatctatcctatgcctgycccaccgttgtattttggaagcagataacttgtttnattrcacaggtccacagatggagaggaattttgccyctgaatgaatctyaccctgagtytctnccayacytgatgyrgrtgatatttcgctgagattgtggactaagagttggtgctggaaggggttagacattggggagatgttgctatgggatgcagggattttgcatgtgagaaggacatgattatggggggagcggagggcaaac

SEQ ID NO: 121 - DNA, 444 bp, Homo sapiens
  repeat_region (1)..(444): mlt2a1
tgtgatggttaatactgagtgtcaacttgattggattgaaggatacaaagtattgatcctgggtgtgtctgtgagggtgttgccaaaggaggttaacattggactcagtgggctggggagaggcagacccacccttaatctgrgtgggcgcmatcyaatcagctgccagcgtggctagaatataaagcaggcagaaaaatgtgaaaagagagactggcctagcctcccagcctacatctttctcccgtgctggatgcttcctgcccttgaacatcagactccaagttcttcagttttgggactcggactggctctccttgctcctcagcttgcagacggcctattgtgggaccttgtgatcgtgtgagttaatacttaataaactcccctttatatatatctattcyattagttctgtccctctagagaaccctgactaataca

SEQ ID NO: 122 - DNA, 549 bp, Homo sapiens
  repeat_region (1)..(549): mlt2a2
tgtgatggttaatattgagtgtcaacttgattggattgaaggatgcaaagtattgttcctgggtgtgtctgtgagggtgttgccaaaggagattaacatttgagtcagtggactgggagaggcagacccaccctcaatctgggtgggcaccatctaatcagctgccagcacggctagaataaagcaggcagaagaatgtggaaggagcagactkgctgagtcttctggccttcatctttctcccgtgctggatgcttcctgccctcgaacatcagactccaagttcttcagcttttggactcttggacttacaccagtggtttgccaggggctctcaggcctttggccacagactgaaggctgcactgtyggcttccctacttttgaggttttgggactcagactggcttccttgctcctcagcttgcagacggcctattgtgggacttcaccttgtgatcgtgtgagtcaatactccttaataaactcccyttcatatatacatctatcctattagttctgtccctctagagaaccctgactaataca

SEQ ID NO: 123 - DNA, 503 bp, Homo sapiens
  repeat_region (1)..(503): mlt2b2
tgtgatggttaattttatgtgtcaacttgactgggctaargggtgcccagatagctggttaaacattatttctgggtgtgtctgtgagggtgtttccagatgagattagcatttgaatcagcggactgagtaaagaagattgccctcaccaatgtgggcgggcatcatccaatccgttgagggcctgratagaacaaaaaggcagaggaagggtgaatttgctctctctccttgagctgggacatccatcttctcctgcccttggacattagaactccaggttctcgggccttcggactycgggacttgcaccagcagccccccagattctcaggccttcggactcggactgaryyacgccaccggcttccctggttctccagcttgcagacggcatatcgtgggacttctcagcctccataatcacgtgagccaattcccctaataaatcycytctatccatcctattggttctgtctctctggagaaccctgactaataca

SEQ ID NO: 124 - DNA, 450 bp, Homo sapiens
  repeat_region (1)..(450): mlt2c2
  misc_feature (260)..(260): n is a, c, g or t
tgtgatagttaattttatgtgtcaacttggctaggctatggtgtccagacgtttggtcaaacaycagtctagatgttgctgtgaaggtattttrtagatgtgattaacatttayagtcagttgactttaagtaaaggagattaccctccataatgtgggtgggcctcatccaatcagttgaaggccttaagagcaaagactgaggtttcccgaggaagaagaaattctgcctcaagactgcaacgtggaaatcctgctgntttwccagcctccaagccttcggactcgaactgcaacatcarctcttscctgggtctccagcctgccggcctaccctgcagatttcggacttgccagcctccacaatcgcgtgagccaattccttaaaataaatctctctctacacacaccctattggttctgtttctctggagaaccctgactaataca

SEQ ID NO: 125 - DNA, 388 bp, Homo sapiens
  repeat_region (1)..(388): mlt2d
  misc_feature (243)..(243): n is a, c, g or t
tgtgatagttaattttatgtgtcaacttggctaggctatggtgtccagacgtttggtcaaacattagtctgggtgtttctgtgaaggttattttttggatgagattaacatttaaatcggtagactgagtaaagcagattaccctccctaatgtgggtggacctcatctaatcagttgaaggcctgaatggaaaaaaagggctgaccctcccccaagtaagaggaaattctgcctgcctgatngtcttcgaactggaatatcagctctgcggattttggacttgccagcctccataattgcatgagccaattccttataataaatctatctactctctctacacacaccctattggttctgtttctctggagaaccctgactaataca

SEQ ID NO: 126 - DNA, 622 bp, Homo sapiens
  repeat_region (1)..(622): mlt2e
  misc_feature (26)..(26): n is a, c, g or t
  misc_feature (35)..(35): n is a, c, g or t
  misc_feature (332)..(332): n is a, c, g or t
  misc_feature (344)..(344): n is a, c, g or t
  misc_feature (389)..(389): n is a, c, g or t
  misc_feature (440)..(440): n is a, c, g or t
  misc_feature (452)..(452): n is a, c, g or t
  misc_feature (575)..(575): n is a, c, g or t
  misc_feature (608)..(608): n is a, c, g or t
tgctggattgttctgttgtcaacttngttaagctnggaactatgtttcccagaatccccttccctgtatggttctgggttagagttggccaaagatgaaattgtggaagatttggaaggcagaagtgaagcagcagccattacactctgaaggtcatcattggttasaggcagtgagagatggccagatgcagaggtgcccaggaggttccagcttgtcctcactctcccctgctcyatatccagctcttcttcctgaccactggccctgctgaccaacagcarccccaggcccaccaccagatgcttggctgcaaactcacagaggtagtngccacacagagncaacaactttccatagagttctccaccagctccccttcatggtcncacttyagcggctggatatgcttagcttcaaatttccccacaagctccagnctcattcaactncgccagagctggttagtgaccctttttctgatccttcaactcccccctccagaccttcacttccccagctcctcccacaattgtataaggtctaattcctataataaatcccttattccatanatactacatagtggctctgcttccctgactganacctgactaataca

SEQ ID NO: 127 - DNA, 661 bp, Homo sapiens
  repeat_region (1)..(661): mlt2f
tgtggtggctttgtaatgtgtcaacttggctaggctggaactacatttcccagaattcccttccctgtatrkttccaggttagggtgggccacaagagacattctgtgtgagatttggaaggcggaagtgaagcagcagccattttgttttctgtgctcggagaggtcagagtcagcaggcgctgttgcagctcacacacgttgtcgctkatctgctggctcacctcgttggcgtggggcagcagccgggcccgcagctgctccascttcccctggatcctccttcagcttctccgactcctgggccaggtgtgtgtktagctccgtgacgaagggcgccagcttctcctgcaggacacccacatcatcgaggtcggaggcagtgagagactgacatgggttccagtttgtcctcgtgggttccagctcatgcttgtgggttccagcttgtccttgctctcccccactttatatccatcttcccttcctgactgcctgccctgtggacttcaagctccagcatcagacgcaragacaacagccttacagagactgcttaaccagctcccacaattgcgtaaggtcaaatccctataataaatctcttattatatatatctcctagtggttctgcttctctgattgaaccctgactgataca

SEQ ID NO: 128 - DNA, 281 bp, Homo sapiens
  repeat_region (1)..(281): msr1
agtcaagacccccagcccctcctccctcagacccaggagtcaagaacccccagcccctcctccctcagacccaggagtcaagaacccccagcccctcctccctcagacccaggagtcaagaccccccagcccctcctccctcagactcatgagtccagacccccagcccctcctccctcagacccaggagtccagacccccagcccctcctccctcagacccaggagtccagacccccagcccctcctccctcagacccaggagtccaggccccacccctc

SEQ ID NO: 129 - DNA, 426 bp, Homo sapiens
  repeat_region (1)..(426): msta
  misc_feature (274)..(274): n is a, c, g or t
tgatatggtttggatctgtgtccccacccaaatctcatgttgaattgtaatccccaatgttggaggtggggcctggtgggaggtgattggatcatgggggcggattyctcatgaatggtttagcaccatccccttggtgctgtyctcgtgatagtgagtgagttctcatgagatctggtcgtttaaaagtgtgtggcacctcccycctctctctcttgctcctgctctcgccatgtgacgtgcctgctcccccttcgccttccgccatgattgnaagcttcctgaggcytccccagaagccgagcagatgccagcgccatgcttcctgtacagcctgcagaaccgtgagccaattaaacctcttttctttataaattacccagtctcaggtatttctttatagcaatgtgagaacagactaataca

SEQ ID NO: 130 - DNA, 465 bp, Homo sapiens
  repeat_region (1)..(465): msta1
  misc_feature (143)..(143): n is a, c, g or t
  misc_feature (227)..(227): n is a, c, g or t
tgctatagtttggatatttgtcccctccaaatctcatgttgaaatttgatccccaatttggcartgttggaggtggggcctagtgggaggtgtttgggtcatgggggcagatccctcatgaatagattaatgccctcctttgnggtgggaatgagtgagttctcactctattgtgggaatctattagttcccataagagctggttgttaaaaagagcctggcacctncctcctctctctctcttgcttgcttcctctctcaccatgtgatctctgcacacgctggctccccttccccttcaccttcygccatgagtggaagcagcctgaggccctcaccagatgcagatgctcgcaccatgctttttgtccagccagcagaaytatgagccaaataaacctcttttctttataaattacccagcctcaggtattcctttatagcaacacaaaatggactaagaca

SEQ ID NO: 131 - DNA, 1651 bp, Homo sapiens
  repeat_region (1)..(1651): mstar
gaawattggtactgaggagtggagcattgctataaagatacctgaaaatgtggaagcgactttggaactgggtaacaggcagaggttggaagagtttggagggctcagaagaagacaggaagatgagggaaagtttggaacttcttagagacttgttaaatggttgtgaccaaaatgctgatagtgatatggacagtaagggccaggctgacgaggtctcagatggaaatgaggaacttattgggaactggagcaaaggtcactcttgttatacattagcaaagagcttggctgcattttgcccctgccctagagatttgtggaagtttgaacttgagagtgatgatctagggtatctggcggaagaaatttctaagcagcaaagcgttcaagatgtgacctggctgcttttaacagcttacagtcatatgcgagagcaaagaaatcacttaaagttggaatttatatttaaaagggaagcagagcgtaaaagtttggaaaatttgcagcctggccatgtgatagaaaagaaaaacccgttttctggagagaaattcaagcaggctgcggagcgaccgtttgctaaagagattagcataactaaaaggaagccaagtgctgatagccaagacaatgggaaaaaggcctcgaaggcatttcagaaatcttcgaggtggtccttcccatcacaggcccagaggcctaggaggactgaatggtttcgtgggccaggcccagggccccgctgccctgtgcagcctcgggacactgctccctgcatcccggctgctycggctccagccgtggctcaaagggccccaggtacagctcgagctgccgcttcggagagtgcaagctataagccttggtggcttccacatggtgttaagcctgcaggtgcacagaatgcaagagtgaaggaggcttggcagcctccacctagatttcagaggatgtatgggaaatcctgggtgcccaggcagaagcctgctgcagggacggagccctcacagagaacctctactagagcagtgccaaagggaaatgtggggttggagcccccacacagagtccccaccggggcactgcctagtggagctgtgggaagggggccactgtcctccagaccccagaatggtagagccactggcagcgtgcaccgccagcctggaaaagccgcaggcatcagactccaacccgtgagagcagccacgtgggctgtgcccagcaaagccacaggggcggagctgcccaaggccttgggagcccacccctcgcaccagcgtgccctggatgcgagacacggagtcaaaggagattattttggagctttaagatttaatgactgccctgctgggtttcggacttgcgtggggcctgtagcccctttcttttggcccatttctcccttttggaatggaaatatttacccaatgcctgtaccaccattgtatcttggaagtaaataacttctttttgattttacaggctcataggtggaaggaacttgccttgtctcagatgagactttggactttggacttttgagttaatgctggaatgagttaagactttgggggactgttgggaaggcatgattgtattttgcaatgtgagaaggacgtgagatttgggggaaccaggggcagaa

SEQ ID NO: 132 - DNA, 405 bp, Homo sapiens
  repeat_region (1)..(405): mstc
  misc_feature (205)..(205): n is a, c, g or t
  misc_feature (212)..(212): n is a, c, g or t
  misc_feature (216)..(216): n is a, c, g or t
tgctacggtttgaatgtttgtcccctccaaaactcatgttgaaacttaatccccaatgtggcagtattgagagrtggggcctttragaggtgattgggtcatgagggctctgccctcatgaatggattaatggattaacgtattaatggattaattggttatcacgggagtgggatcggtggctctatcataaaarycattttgnctctcgnrtgngccccttcttgccctttcacgccttccgccatgttatgacagagcacaaggccctcaccagaaaccagatgcagccgccatgatcttggacttcccagcctscagaaccgtgagcaaaataaacctcttttctttataaattacccagtctatggtattccgttaaagcagcacgaacggactaagaca

SEQ ID NO: 133 - DNA, 630 bp, Homo sapiens
  repeat_region (1)..(630): ors1
  misc_feature (461)..(461): n is a, c, g or t
ycccatacygtttccrtcactrgtytgwgcaccctctgcarggmagacagcatgayttttyatctttgaatycyyaaaasttagctcactgtgtgctcaaacgtgtattgaatgacagttgctatatttgaggacbacatagattttggggaagacggacaggcacactagcagaaccatacgaaggccaggatcagtcatgaccagggctgcattatgacttgtgggccctgagcacttttgcttttatgggccccttcctccataaaaatattaaaaattatattttatgactgcattggtataaagatgagaatataatccaggctgaattaaaacattttcttagactctaaaatttcatttttttctgattttaaaagaaattaaaacattttyatggggccctaaagtattgtgggccctaggcactgtgcctactgtgcctaatggataagtcnagcctgaccagggcactctggtgtgaggttgaagaaaggaaatttggaacaaagaagccaagtgctctggagaagcaggtgaaacttccactgccgaacaaaatcagaatgggagcagccatggttaataaggttgtggaagtttagascttccagttcacttcmcctt

SEQ ID NO: 134 - DNA, 660 bp, Homo sapiens
  repeat_region (1)..(660): pabl_a
  misc_feature (88)..(88): n is a, c, g or t
tgtggcaggccaggtctcactaacacaggcctccataacaactgtttcagcactgactgagtggttaagttaaatattaaaagctganagagccagtgcccttatacaaaggctggaatgtaacaaaagcccaccaagagttttgcctaggcctttcctgggccttgaagcatgacaaaataacgaaggaattcttaacaggacccgtttaggattaaacaagttttactgggggtctgaagaaactccccaggcctccacaaacaagtttattgggggtctgaaggaactccccaaacctccgtgatttagcaggagacaagataagggtaatcaccccagcacctggacccatttagattaagtaaatttactgaggctccagaggaaggtcttcaggactcagaccttagttatagattagaagaagttaatcacttatgtctttagatgaatgcacacttacacgtagacatatagcttagaaggtatataagctctggaaaactttgtaattttgagttggtctggtgataatttccaggccttctccctgtaaccggttacagaaataaaaactctcttcctccccagttcatctgcatctcgttattgggccacgagaaatagcagcccgaccctcagtttggtccgggaaca

SEQ ID NO: 135 - DNA, 667 bp, Homo sapiens
  repeat_region (1)..(667): pabl_b
  misc_feature (98)..(98): n is a, c, g or t
tgtggcaggccaggtctcactaacagctgaacaggcaggcctccatgacaactgtttcagcactgactgagtggttaagttaaatattaaaagctganagagccagtgcccttatacaaaggctggaatgtaacaaaagcccaccaagagttttgcctaggcctttcctgggccttgaagcatgacaagataacgaaggaattcttaacaggacccgtttaggattaaacaagttttattgggggtctgaagaaactccccagacctccacaaacaagttttattgggggtctaaaggaactccccaaacctccatgatttagcaggagacaagataagggtaatcaccccggcacctggacccatttagattaagtaaatttactgaggctccagaggaaggtcttacaggactcagaccttagttatagattagaagttaatcacttatgtctttagatgaatgcacacttacacgtagacatatagcttagaaggtatataagctctggaaaactttgtaattttgagttggtctggtgatattttcccggccttctccctgtaaccggttacagaaataaactctcttctttcccagttcatctgcatctcgttattgggccacgagaataagcagcccgaccctcggtttggtccgggaaca

SEQ ID NO: 136 - DNA, 90 bp, Homo sapiens
  repeat_region (1)..(90): pmerl
tagagcagtggttctcaaccttcctaatgccgcggccctttaatacagttcctgtgggtcgcgacccacaggttgagaaccgctgctata

SEQ ID NO: 137 - DNA, 7756 bp, Homo sapiens
  repeat_region (1)..(7756): prima41
tctttctggcgaaccacggaagggacgatactgaagaaaccccccgaacccaaaggaaatagactgcagcactgattggacgactttgggtaagtggtgggggtatattctatacccgggtaaagaatgggattgggttagaggcccaacttaggggagttagagtctctcctaagacagagtgggttagaggcccctcttaataaaaggcaaggacgcttgaccgaccttgggttagaggcccaacttaggagggttagagtcccttctaagatttagggggttagaggcccctctcggtaaagtccctctcggctaaaaatgggtttggcactgcaggatgtttatcgctatgctctttggattaatttgccttgtcctccttgctkcmtgaatcaatttcttggttgctgtctctgtttcactgtcattttcaggagactttatttaactggtcttagggattttaacttactcttttcctatgtgcctcctgatttccgtctgtctgcttgtgaaacattgggaacaaaaagcattgaaggctctgtctctaaaattgctgattgagatttggtatttaacagctatgagcaataaaattagacagatgtggttatgttttgttgccgctatgccgactaggtgtgatcgagaagcactaggatggaaatcaggggacttttctccttgctgttttgtttcattttgcacactaaaaaaacttctttcctttcttggattcaggcaaaccggctttgcttgttcaatccacactgccgctattgcccagaacctgcttgctctggtcattcccatctaaatcctcttcatttcctttgccttatttgacatttttgtcaaagtccatgttgtggtttatctaagattcatggctcggctcacttatgttatttggataatgtgaataagggaattcaattttcagcaggttttccgtcataatgcagcgtgccttaagaactgtctcctttttgatggaacttggccaatggcaatacagtctcacgggtttggaagttttctttcaacgtcatctgcctcctttatggggaatacagcatggatcccagaggactcaccactaggatgtattcttgaacattgggacaagtttaaaccaaatggacttaagaaaagaaagttggtggtttcatataatactgtctggcctcaaattactatacttggaaaaataagaaaaatggtcaactaccagaactatggcctttaatactatacttccacttgatttgttttgtaagtgtgagggcaaatgggataaaaccaatacgttcaagcatttttattgcccagtcaaaataaaactctgcaataggtatgtgcatgtttgatgagaggaaaggaaggaaaataagaaaaagaactagacatactagatgatcctttaatgcaagcccccctccccgcccccgccaaccttggttcagcaggcagttttgggtggagcagaacctccttctgtcagctctgatggttcagatgtgttggcctcttcttctagcccctctgaaagttctgttgagaaccctttgtcccctcctccttacccgtctagtcccactctatacccaccactccctgaggaacttagcccagtgagtactactcgtagtggagcctcctatcaacttccaaagggaaatctttgtccacttagagaggtggcaaatggggaagaaggcactgtgagagtacatgttcccttttctatgtctgatttgactctatgtaaagagaagtttggtcatttctctgaagatccaggaaaattcatagatgagtttgagaaattaactctgacctataatttaacttggcaggatctgcatgttttgttgtctctgtgttgtacagtggaagagaaacaatacattttggggacagctaggacccatgcagatgaggtattggctcgtaacccgaaccataatatatatcaggcaggaggtatagcagttccagatcaagatccagagtggaactatcaaaggggcagtgaggacttggggaggagagatcatatggtcacttgtttgttggaagggatgaagaaatgtatgaaaaagcctgttaactatgaaaaggttaaggaagtttctcagggcaaagatgagaatccagctttgtttcaagggcatttagttgaggcaatcaggaaatatactaacactgatcctgcctcaagggaaggacaaacccttttgggagtacattttataacccagtctgcccctgatatccataggaaactacaaaaagcagctatgggtccccaaactcctatggaacagcttttggatatggcatttttagtttttaataacaaggacaaagcagaggaagcagaaagagcaagaaggacctcccacaaggtgcagctcttggctgcagccttaagctcacctcccacatggggttgccctcctggctcttggcctgaacaagggaagctgaaaggtgggaagcccaaagctgggcgtccgagtcaccgtgccttgggcacgaatcagtgtgcacactgtaagaaaactggccattggaagagggatttcccagtgttctgaagggagccatcggcacctgaaccaatgatggccgaaatagccaggcaagcccaagagtgatggggcctcagaccttccaccacagctcccatcggacaactagccatatctccggagaagcctcgggtaacccttgacgtggcaggtaagaatattaacttccttctggatacaagggctgcttactctgttttgacccattataatgggactctgtcaccccaaaactgtatggtcatggggatagatggacaagctcatagatgccattttacctatcctttaagctgctcttcagggactttggttttctcatatgccttttcttatcatgcctgaatgccccaccccttgttgggaagggatttgttaactcagctgcaaacagtagtatcttttggaaatcacaaggcagacaaaaaattgctccttctcctttcctgtgataagggaggaaagtcaatagggacttatctagcttgcctattgaagtaacctcccaaataaatcctgtagtatgggacattgaggttccagacaaagcattaaatgttcctctggtttgcatttagcttaagcctgatgccctgtactcctggaagagacaagatcccctaaaaccagaggcataaagagggattcatccattaagaactaagtttttgcaatttggtttgttaagaccctttaagtttccttgtaatactctaatcttgccaattaaaaagccaaatggagactatatatttgttcaagatctttgagctgtcaacagtgctgtcattcccaaacatcctgtagtactcaacccctacatgctgttagcccaggtccttggggatgcaagttggtttacagtcttagatctcagggattttttttttttctgcatttgagtataccctgattcaaaatttatctttgcttttggatggactgacccttgatagtcatttggtttctcaattaacttggatggtttttccccaggagtgtagggacagcccacatttatttggaaatacattgactagagaattaaagatgttaaaattgaataggggcactagtatttggtatgtgaatgatttgttggtagctagcccaactaaaaggggctcaaataaaaatgccattaagttgctaaattttctggacactaatgggtatagagtgtcactgcataaggcccatgtttcaactcaagaagttaaatatttaagatatgtcttaacccctggcacctgggcaatagcccccagaaaaaaaggaagtgatcttgggaatcctggaaccccaaaccagaaagcagctatgggatttcctaaggatgggaagattctgctcttaatgagtgcctggatttgggcatatggccaagtctttatgtaaggctctaaaaggagcacacgtgatctttttgaatgcagtatcaattgtaaaacatacttttaatactctcaaggagaaactgggaacaactccagccctagggatccccaatcttgataagccatttcctttatttggctgaaaaacaaggaacgctctggaagtccttgtccagaaactgggaggcatccctgaccagtagcatatttttctaagtaattagaccatgtagctttgggatggcccagatgtctcagggcagttgcagcaatggctcttttggtatatgaagccaataaactggctttgggacaacatctggaggttttgaccccacaccaagtacaaggagtactagaagctaaaagacaccagaggatgactgggggacatgtatataaatatcaggctttgttgctaaacatcctgatataactcttaaagtatgccagactttgaatccagctacctatttgcctgaacccacaggcaccctagatcattcttgcatacaagttatggagcaagtttactccagctgtccggatttaaaggatgagcctctagataatcctgaggtagaatggtttacagatggaagtagctttgtgcaccagggaaacggaaaagctgggtatgctgttgtcagtcaacatgaggtaattgaatctcaggccttaccggcttctacctcagctcaaaaggcggaattaatagctcttattagagccctgcaattgggaaaggacttaagaattaacatttccactgattctaagtatgcctttctggtacttcatgctcatgctgctatctggaaggaatggggactcctaactgctaagggttcccctataaaacatcacttagaaattcggaatctgttggacgccgttttgctgcccaaggaagtagctataatccattgcagaggtcatctgaaagggaactccagtgtgactaagggaaactcctttgcagatgcagctgctaaggccacagcattaaaggatccagttggacttgttggtatgttggtgccctcagccacggtaataacagaaccgagatatactaaagaggaacaagaatgggctaaaggtcagggtttaattcaagatccttctggctggcttatcaatgacaacaaactgttgacaccaggtgctaatcagtggaaaatagttaaacatttgcatgactctactcatttgggaagagattccctgtttcaattaatgtctcagctttttataggaaaaggcttacttaaaacagtaaagcaggtaactcaggcctgtgaactatgtgcccggaataacccaaataaccaatctttacctcctcctctagtaaggcctgttcagcacaggggaacgtaccctggtgaagactggcaaatagactatactcagatgcccccatgtaaagtgtttaagtatttattagtatttgttgacaccttttctggttggatcgaggcttttcctacctggtctgaaaaggcaattgaggtttctaaactcctactaaaggaaataattcctagatttgggctgcctaagagcttgcagagtgataatggcccatctttcacagcgacaattacccaaaacatatcttcagccctaggaattcagtaccgccttcattcagcatggaggccacagtcttcagggaaagtagaaagagctaatcaaactctaaaaaggactcttgctaaactatgccargaaacatcagaaacctggctgtctttattgcctgtggccttgttacgggtttaaatggcccctaaaggaaatctgcagctcagtccttttgaaataatgtatggaagacctttcttaactacagacttcctaatagacatagatactttcaagctacagaattatgtgatcaacttaggacaagtgcaaaacgcactccttgaatatggaaatcaaagactcccttcccccactaaggaagagaatcttgttacaacccagccgggagactgggtcctattaaaaacttggaaggaaggatccccagcagatcaactttcccccaaatggaagggatcctatcaagttctccttagtaccccaactgcagttaaacttctgggaataaacagctgggtccacttatcttgaattaaacctgtctcttatgaagtcccacaggccagtggaacacaagagactgatcccgtttattcctgtgagccaatcagtgacctctgactcctgttcagaagaaacgaaagggatgggtaacataaagatatggattggcattctacttttgggtataagttggaatcatgcagagagtaacttatttactgagtgggcacagactttagcctctctacataatcagacaaactgttgggtatgtggaaaattaccactttcctccacttccggattgccctggcatattcaaccggccaacctaagtttgtgggggactttattatgattgggaaactgaaaataataaacatacaccctctttccccatgcgctatagcttgtgtggcctaagcccatttcctctcatgcggagagacaagaaggvaccttttttttttgtctaattaggaaacagctaaattccaccccaacttaggttatactgtacagaatggacttgggtggatgacaggtatcaggcaaagcacctctatgttttgaaaggcacaataatagtcaccaccagactggaacccgtgatatgggatggttgccacctcaacaatgtaatcagacccttcttttaacagaccagatgtggatgggatggcaacataatttgccaaaaatgggtgcctacccttctccttggggatggttatgggcttgtagaactcatggctggccatacttaccttataactggactggaaggtgtatgtggggttgcccttatctcccgggatgtatcctcaccaaattggactctctgccatctaactgggaaattgtaaaggctcgccataggcgacaaaaacaagcatcttggtggttttaccccatggctatattttccccacaggcagctaccaaattavatattgagtgacaagttgaagcagcctcagccaagcacacagttgcagctttcaataatacatgccatgctgccttacccttacctaactgaggaaacttctcagattaggcaggtagccttacaaaaccgtatggctttggacattttaacagcggcccaagggggaacttgtgctttgatcaaaaccgaatgttgtgtgtatgtttcagactattcacatactattacccaggctatgaaagctttagacactcatatctctgccactgatgtgctatcagtcgaccctatatcggcttggttccaacaactgcccagttcttggaaagccttcctgtttagtttacttggaatgattttacttattttgctttgctgttgtggaatatattgcggttgtactctttgtgtaggaatgcaagacaagcttactcaatgctttcttaaattggacacttattaatcttccagatatcaccttttgtcggaactcggagttatgaacgaccctcaccataccgatgctttctgactgagctcctctctaccctgaatgcaagagaccctaatagttaggcaggaatatcatcgcccctattcagcctgaagaagttacagaagatggatcttcgtccctctgcaacccttaggattaagggtcttcttgtaaagggaggggggagata

SEQ ID NO: 138 - DNA, 630 bp, Homo sapiens
  repeat_region (1)..(630): ptr5
tgagaggtggcagtgtgctggcagccctcgcagccctcgctcactcttggctcctcctcggccttggcgcccactctggccatgcttaaggagcccttcagcctgccactgcactgtgggaacactggccaaggccagagccagctcactcagcttgtggggaagtgtggagggagaggcgcaggcgggaactggggctcgatgcggcgcttgcgggccagcgtgagttccggtggttggtggcttggcgggccccagactcggagcggctggcctgccctgctggccccaggcagtgaggggcttagcacccaggccagcagctgtggatggtgcgctgagtctcccagcagtgctggcccaccccaccagcactgcactcgatttctcgccaggccttagctgcctccccgcaggcaggccttgggacctgcagcccaccatgcctgagtctcccctgctgccgccgtgggctcctgcgtggcccaagcctccccgacgagcactgccccctgctccccggtgcctggtcccatcgaccccaagggctgaggagtgcaggtgcatgctgcgggactggcaggcagctccacctgcggccccatgcaggaagccagctgggctcctgag

SEQ ID NO: 139 - DNA, 66 bp, Homo sapiens
  repeat_region (1)..(66): r66
acagagtgctgattggtgcrtttacaaacctttagctagacacagagcgctgattggtgcgttttt

SEQ ID NO: 140 - DNA, 2030 bp, Homo sapiens
  repeat_region (1)..(2030): ricksha
  misc_feature (659)..(661): n is a, c, g or t
gggtttggatcataatcccgaaagacacaatcccaaacgccataatcccgaatgttgaaatcccgaaagatcaaaatcctaaagtctaaatccctaaagtctaaaatccctaatgtctaaaatcccgaaaatcacaatcacgaaagattaaaatctcaaatattgaaatcctgaaagccgaattctggggaagggattagtgcgttttcggttgtacgcaggatagttgcatcatgttagttgcatcatgttaggtggcagaactattaccttgttattgtctttatttggaaattaagtatggtttaaggagacacgtatgggtgccaagttgacaaggagtggacttgtggacttaattttaggtgtcaacttgactggattaaggaatacctagaaacctggtaaagcattattttgggtgtgtctgtgagggtgtttccagaggagattagtgtgtgagtctgagcggactaggcggggaagatctgccctcaatgttggcgagcaccatccaatcggccgggggcccggagagaacaaatacagaaggcgaactggtctctctctgagagctgggacagatttttcttctgctgccttggacatcagaactctgggcttgctggctttggactccaggacttacaccagtcctnnnaaccgggtcctgaggctttcggacctcagactgagagttacaccattggcttccctggttctgaggcttttggacttggactgagccatactgccggcatcccagggtctccagcttgcagacggcctgtcgtgggacttctcagccaccataatcgcgttagccaattcttctaataaattccctctcatrtatatatatatcatattggttctgtctctctggagaaccctgattaatacagatttggtattggggaagccgaatatcattccttcttactgtattccttacaacataatagaagagatctgtgaaattgttccctcacaaaaaggctgtgataaaataagtggacgaggctactcaattgtgaaagataaaatttaaaagctaattattattggtgctgcaaaagcagaaaatcacttaattacaatggccgagcaataaccagcttttaaatggacagcatatacttacaaaatttgtagaccacaaccactctgcaaatacacatgcagcaagtgtcttgaagatggcaamartgaaaattcagtttaaaaatacawsaattscctgccaaattattcaatctgtatgacttctacttctttacacaaaatttatgctatgtatttcatcttcgcatcatttccaatactggaggtataaattgtgtagagacttttagagagttctaatttgttttatgcattttttgcaaatttgactccacgaaagtgcattatcacaatgttgactttgtgtgtaagcattgtgcatgtatgtaaaaacgttgaaacttcctcaataaatgaagagatgtcctttttgtacatctgcatttgtgaaagataaaatttctcaagatcttggctctttgggcgactgcatatgcggtggtgacccatcgcggtttttgatcgatctcgtcaaaagacttaggttgttcgtcacggtatttcagatgaccgcagttataaagctgggtgcacacaattaccaaccatagtgatatgcgtttatacatttccctttttgacctatttctttatgaatacggttcgtctgctcataactgttatacccgtgcgactgtcattagtatacctgagtgtttatgcttgcaaaaatatgtatgttattattgcctattttattgtgtaaagtggcctatgaagtgttctgtcatgtttttatatgtttctcaaataaatccccttttaaaaatgtaaataaattatcttttaaagaatttttaaattttttttcagaattatattttcgggattttgatctttcgggatttcaacattcgggattatggcgtttgggattgtgtctttcgggattatgatccaaaccc

SEQ ID NO: 141 - DNA, 42 bp, Homo sapiens
  repeat_region (1)..(42): SAR
acataaaatatcaaagtacatcaaatatatattttattctgt

SEQ ID NO: 142 - DNA, 470 bp, Homo sapiens
  repeat_region (1)..(470): satrl
agggagaggatgatattactcccaatatcacagggggtgtacaccccccctgtgatattgttcctaatatccagggggggagaggatgatattactcccaatatcacagggggtgtacaccccccccccccccccsyacaccccccctgtgatattgttcgtaatatccagggggggagaggagaggatgatattactcccaatatcacagggggtgtacaccccccctgtgatattgttcgtaatatccagggggggagaggatgatattactcccaatatcacagggggtgtacaccccccctgtgatattgttcgtaatatccagggggggagaggatgatattactcccaatatcacagggggtgtacaccccccccstacvcccacmccccctgtgatattgttcgtaatatccagggggggagaggatgatattactcccaatatcacagggggtgtacacccc

SEQ ID NO: 143 - DNA, 455 bp, Homo sapiens
  repeat_region (1)..(455): sn5
cttcccttcagggacctcaaagtgaccagcttccccttgaagaatgactctccaaggcccaggagcccagcttctgggcctccaagccaggccatctggcgagggagtcggtggacgtgccctggcttcttccatgttgagttggtactacccaccaaggggggtagagaggcgagcagatgttgtctctggcctgtgtcttgttatcatggtgctgactaggcctggtacagggccctgatggggttgtcctgggtggtcacgggggtgatgagaagaagatgcagaatggattgctgtgaggatgaatgagacgactgtcagtacagacaggcacacggtgaagtgttcagggattcccctcagtagctgcccagacccaaaacctgactcctgagtcacgttactgtcccactatacgttaagaggagggaaagctgggtcgcgcaggtccc

SEQ ID NO: 144 - DNA, 1640 bp, Homo sapiens
  repeat_region (1)..(1640): sva
ctccctctccctcaccctctccccatggtctccctctccctctctttccacggtctccctctgatgccgagccgaagctggacggtactgctgccatctcggctcactgcaacctccctgcctgattctcctgcctcagcttgccgagtgcctgcgattgcaggcgcgcgccgccacgcctgactggttttcgtattttgttagtggagacggggtttcgctgtgttggccgggctggtctccagctcctaaccgcgagtgatccaccagcctcggcctcccgaggtgctgggattgcagacggagtctcgttcactcagtgctcaatgatgcccaggctggagtgcagtggcgtgatctcggctcgctacaacctccacctcccagcagcctgccttggcctcccaaagtgccgagattgcagcctctgcccggccgccaccccgtctgggaagtgaggagtgtctccgcctggccacccatcgtctgggatgtgaggagcgtctctgccctgccgcccatcgtctgagatgtggggagcacctctgcccggccgccccgtccgggatgtgaggagcgtcgctgcccggccgccccgtctgagaagtgaggagaccctctgcctggcaaccgctccatctgagaagtgaggagcccctccgcccggcagccgccctgtctgagaagtgaggagcccctccgcccagcagccacctggtccgggagggaggtgggggggtcagccccccgcccggccagccgccccgtccgggagggaggtgggggggtcagcccccagcccggccagccgccccgtccgggaagtgaggggcgcctctgcccggccgcccctactgggaagtgaggagccactttgcccggccagccactctgtccgggagggaggtgggggggtcagccccccgcccggccagccgccccgtccgggagggaggtggggggatcagccccccgcccagccagccgccccgtccgggagggaggtgggggggtcagccccccgcccggccagccgccctgtccgggaggtgaggggcgcctctgcccggccgcgcctactggaaagtgaggagcccctctgcccggccaccaccccgtctgggaggtgtgcccaacagctcattgagaaggggccatgatgacaatggcggttttgtggaatagaaaggggggaaaggtggggaaaagattgagaaatcggatggttgccgtgtctgtgtagaaagaggtagacctgggagacttttcattttgttctgtactaagaaaaattcttctgccttgggatcctgttgatcggtgaccttacccccaaccctgtgctctctgaaacatgtgctgtatccactcagggttgaatggattaagagcggtgcaagatgtgctttgttaaacagatgcttgaaggcagcatgctccttaagagtcatcaccactccctaatctcaagtacccagggacacaaacactgcggaaggccgcagggtcctctgcctaggaaaaccagagacctttgttcacttgtttatctgctgaccttccctccactattgtcctgtgaccctgccaaatccccctctgtgagaaacacccaagaatgatcaataaaaaaaaaaaaa

SEQ ID NO: 145 - DNA, 2111 bp, Homo sapiens
  repeat_region (1)..(2111): tarl
gatcaacagtgaggaggtcccacaaggctaagtggggcaagtcggggacctaaggcagtagcaggaaaaccaaagaaaacaggcggagacttgagacagaggcaggaatgtgaagaagtccaaaataaaaatccctgcacaggactcttaggctgttatcatgcactatcagcctactcctccctatttttgtacaataagctctttacactgtatttcttttcaatgaagttatcttccatctttgtactgcctcttggtgaaaagctgtcttccaagttaataactgggacatcagctctctgcagtaatagctccttttcagttttaatttgcagaactgatggggattaataactggcgctctgactttaagtggtgcaggaggcggccagtaggggacgccagccgttacgccgggagcaagagggccctgcgtagtccccatctgcctgcatgtggcgtgcagccacgacaatggcagcaagagggcccggcagtgtgcccagctgccagcaggcgggtgtgctgccactataatgtgaggaagagggccctgcaatgtccctagctgccagcaggcggcgtgccaccactatactgcgagcaagagagccctgccgtgccccggcgccagcagggggcgctggacagcactgtaagcaagagggccctgcagttgtcctagtcgccagtaggggacgcaatggcagagcaccgtgggcaagctggtcctgtagtgcccggctgcaagcagggggcgcccgaaacgggcttttcagattactcaggttccactcgtctctgcgccgccggggacgtgtgtctctgcgcgtgcaccgcgccacccccgcgctccccgcccggcggcgcgcgactgtgcgactgcaacactccccgccaccctcagcccagcgacgtgcgtctctgcgcctgcgccgcgcctcactcccgcccgctcagcgacccctcccttccggggaggcgccggcgtgcgtctacgccctgcgccgcgtctccccaacagcggcgcgcctctctgcgcctgcgccggcgcgccgcgcctctctgcgcctgcgccggcgcgccgcgcctctctgcgcctgcgccggcgccccgcgcctctctgcgcctgcgccggcgccccgcgcctctctgcgcctgcgccggcgccccgcgcctctctgcgcctgcgccggcgccccgcgcctctctgcgcctgcgccggcgccccgcgcctctctgcgcctgcgccggcgccccgcgcctctctgcgcctgcgccggcgccccgcgcctctctgcgcctgcgccggcgccccgcgcctctctgcgcctgcgccggcgccccgcgcctctctgcgcctgcgccggcgccccgcgcctctctgcgcctgcgccggcgccccgcgcctctctgcgcctgcgccggcgccccgcgcctctctgcgcctgcgccggcgccccgcgcctctctgcgcctgcgccggcgccccgcgcctctctgcgcctgcgccggcgccccgcgcctctctgcgcctgcgccggcgcgccgcctttgcgagggcggagttgcgttctctttagcacacacccggagagcatcgcgagggcggagctgcgttctcctctgcacagacttcgggggtattgcgaaggcggagcagagttcttctcaggtcagacccgggcgggcgggctgagggcactgcgagggtggagctgcgttctgttcagcacagacgtggggggcaccgtaaaggcggagcagcattcttctcagcacagacgttgggggtactgcctgcctttgggataactcggggccgcatcgagggtgaataaaatctttcccgtttgctgccctgaataatcaaggtcagagaccagttagaacggtttagtgtggaaagcgggaaacgaaaagcctctctgaatcctgcgcaccgagattctcccaaggcaaggcgaggggctgtattgcagggttcaagtgcagcgtcagaactcaaatgcagcattcctaatgcacacatgacaccctaaatataacaggcatattactcatggagggttagggttcaggttcgggttcgggttcgggttcgggtt

SEQ ID NO: 146 - DNA, 364 bp, Homo sapiens
  repeat_region (1)..(364): thelb
  misc_feature (192)..(192): n is a, c, g or t
tgatatggtttggctgtgtccccacccaaatctcatcttgaattgtagctcccataattcccacgtgtcgtgggagggacccggtgggaggtaattgaatcatgggggcgggtctttcccgtgctgttctcgtgatagtgaataagtctcacgagatctgatggttttataaaggggagttyccctgcacangctctcttgcctgccgccatgtaagacgtgmctttgctcctccttcgccttcygccatgattgtgaggcctccccagccatgtggaactgtgagtccattaaacctctttyctttataaattacccagtctcgggtatgtctttattagcagcatgagaacggactaataca

SEQ ID NO: 147 - DNA, 1580 bp, Homo sapiens
  repeat_region (1)..(1580): thelbr
gtaaattggtaccagtagagtggggcgctgctgaaaagatacccgaaaatgtggaagcgactttggaactgggtaacaggcagaggttggaacagtttggagggctcagaagaagacaggaaaatgtgggaaagtttggaacttcctagagacttgttgaatggctttgaccaaaatgctgatagtgatatggacaataaagtccaggctgaggtggtctcagatggagatgaggaacttgttgggaactggagcaaaggtgactcttgttatgttttagcaaagagactggcggcattttgcccctgccctagagatttgtggaactttgaacttgagagagatgatttagggtatctggcggaagaaatttctaagcagcaaagcgttcaagaggtgacttgggtgctgttaaaggcattcagttttaaaagggaagcagagcataaaagttcggaaaatttgcagcctgacaatgcgatagaaaagaaaatcccattttctgaggagaaattcaagccggctgcagaaatttgcataagtaacgaggagccgaatgttaatccccaagacaatggggaaaatgtctccagggcatgtcagagatcttcgcggcagcccctcccatcacaggcccggaggcctaggaggaaaaaatggtttcgtgggccaggcccagggtccccgtgctgtgtgcagcctagggacttggtgccctgcgtcccagccgctccagccatggctaaaaggggccaacgtacagctcgggccgtggcttcagagggtgcaagccccaagccttggcagcttccacgtggtgttgagcctgcgggtgcacagaagtcaagaattgaggtttgggaacctccgcctagatttcagaggatgtatggaaacgcctggatgtccaggcagaagtttgctgcaggggcggggccctcatggagaacctctgctagggcagtgcggaagggaaatgtggggtcggagcccccacacagagtccctactggggcactgcctagtggagctgtgagaagagggccaccgtcctccagaccccagaatggtagatccaccgacagcttgcaccgtgcgcctggaaaagccgcagacactcaacgccagcccgtgaaagcagccaggagggaggctgtaccctgcaaagccacaggggcggagctgcccaagaccatgggaacccacctcttgcatcagcgtgacctggatgtgagacatggagtcaaaggagatcattttggagctttaagatttgactgccccgctggatttcggacttgcatggggcctgtagcccctttgttttggccaatttctcccatttggaatggctgtatttacccaatgcctgtacccccattgtatctaggaagtaactaacttgcttttgattttacaggctcataggcggaagggacttgccttgtctcagatgagactttggactgtggacttttgagttaatgctgaaatgagttaagactttgggggactgttgggaaggcatgattggttttgaaatgtgaggacatgagatttgggaggggccaggggcggaa

SEQ ID NO: 148 - DNA, 2418 bp, Homo sapiens
  repeat_region (1)..(2418): trigger1
caggcatacctcgttttattgcgcttcgctttattgcgcttcgcagatactgcgttttttacaaattgaaggtttgtggcaaccctgcgttgagcaagtctgtcggcgccatttttccaacagcatgtgctcacttcgtgtctctgtgtcacattttggtaattctcgcaatatttcaaactttttcattattattatatctgttatggtgatctgtgatcagtgatctttgatgttactattgtaattgttttggggtgccacgaaccgcacccatataagacggcgaacttaatcgataaatgttgtgtgtgttctgactgctccaccgaccggccgttcccccgtctctctccctctcytcgggcctccctattccctgagacacaacaatattgaaattaggccaattaataaccctacaatggcctctaagtgttcaagtgaaaggaagagtmrcacatctctcactttaaatcaaaagctagaaatgattaagcttagtgaggaaggcatgtcaaaagccgagataggccaaaagctaggcctcttgcgccaaacagttagccaagttgtgaatgcaaaggaaaagttcttgaaggaaattaaaagtgctactccagtgaacacacgaatgataagaaagyaaaacagccttattgctgatatggagaaagttttagtggtctggatagaagatcaaaccagccacaayattcccttaagccaaagcctaatccagagcaaggccctaactctcttcaattctatgaaggctgagagaggtgaggaagctgcagaagaaaagtttgaagctagcagaggttggttcatgaggtttaaggaaagaagccatctccataacataaaagtgcaaggtgaagcagcaagtgctgatgtagaagctgcagcaagttatccagaagatctagctaagatcaytgatgaaggtggctacactaaacaacagattttcartgtagatgaaacagccttctattggaagaagatgccatctaggactttcatagctagagaggagaagtcaatgcctggcttcaaagcttcaaaggacaggctgactctcttgttaggggctaatgcagctggtgactttaagttgaagccaatgctcatttaccattctgaaaatcctagagcccttaagaattatgctaaatctactctgcctgtgctctataaatggaacaacaaagcctggatgacagcacatctgtttacagcatggtttactgaatattttaagcccactgttgagacctactgctcagaaaaaaagattcctttcaaaatattactgctcattgacaacgcacctggtcacccaagagctctgatggagatgtacaaggagattaatgttgttttcatgcctgctaacacaacatccattctgcagcccatggatcaaggagtaatttcgactttcaagtcttattatttaagaaatacattttataaggctatagctgccatagatagtgattcctctgatggatctgggcaaagtaaattgaaaaccttctggaaaggattcaccattctagatgccattaagaacattcgtgattcatgggaggaggtcaaaatatcaacattaacaggagtttggaagaagttgattccaaccctcatggatgactttgaggggttyaagacttcagtggaggaagtaactgcagatgtggtggaaatagcaagagaactagaattagaagtggagcctgaagatgtgactgaattgctgcaatctcatgataaaacttgaacggatgaggagttgcttcttatggatgagcaaagaaagtggtttcttgagatggaatctactcctggtgaagatgctgtgaacattgttgaaatgacaacaaaggatttagaatattacataaacttagttgataaagcagcggcagggtttgagaggattgactccaattttgaaagaagttctactgtgggtaaaatgctgtcaaacagcatcacatgctacagagaaatctttcatgaaaggaagagtcaattgatgcggcaaacttcattgttgtcttattttaagaaattgccacagccaccccaaccttcagcaaccaccaccctgatcagtcagcagccatcaacatcaaggcaagaccctccaccagcaaaaagattacgactcgctgaaggctcagatgatcgttagcattttttagcaataaagtatttttaaattaaggtatgtacattgttttttagacataatgctattgcacacttaatagactacagtatagcgtaaacataacttttatatgcactgggaaaccaaaaaattcgtgtgactcgctttattgcgatattcgctttattgcggtggtctggaaccgaacccgcaatatctccgaggtatgcctg

SEQ ID NO: 149 - DNA, 2718 bp, Homo sapiens
  repeat_region (1)..(2718): trigger2
  misc_feature (1061)..(1061): n is a, c, g or t
cagttgacccttgaacaacacgggtttgaactgcgcgggtccacttatacgcggatttttttcaataaatatattggaaaattttttggagatttgcgacaatttgaaaaaactcgcagacgaaccgcgtagcctagaaatatcgaaaaaattaagaaaaagttaggtatgtcatgaatgcataaaatatatgtagatactagtctattttatcatttactaccataaaatatacacaaatctattataaaaagttaaaatttatcaaaacttacgcacacacttacagaccgtacatggcgccattcgcagtcgagagaaatgtaaacaaacgtaaagatgcagtattaaatcataactgcataaaattaactgtagtacatactgtactactgtaataatttcgtagccacctcctgttgctattgcggtgagctcaagtgttgcgagtatccgcttaaaacgccatgtgacgctaatcatctccgcgtgagcagttcgtctctccagtaaattgcgtatcgcagtaaaaagtgatctctcgcggttctcgcgtatttttcatcgtgtttagtgcaataccgtaaaccttgaataacaccatgggacccatacgaagtgccactagtgatgctggaagtgctcccaagaagcagagaaaagtcatgacattacaagaaaaagttgaattgcttgatatgtaccgtagattgaggtctgcagctgcggttgcccgccatttcaagataaatgaatccagcataaggaccattgtaaaaaaagaaaaggaaattcgtgaagccgtcgctgcagctatgccagcaggcgcgaaaaccttgcactttttgcgaaatacctttttatctcgtattgaaaatgcagcttttatgtgggtgcaggattgctataagaaaggcatacctatagactctaatatgattcgagaaaaagcgaagtcattatatgacaacttaaagcaaaaggaaggtgaaggatctaaagctggagaatttaatgccagcaaaggatggtttgataattttagaaagaggtttggcttnaaaaatgtcaagataacaggagaagcagcttctgccgaccaagaggcagcagacgagttcccagatgccattaagaaaatcattgaggagaaaggatatctgcctgaacaggtttttaatgcagacgaaagtgccctattctggaggaaaaaaatgccacaaaggacatttattagtaaggaagagaagcaagcaccaggatttaaggcaggaagggataggctaactctactgttttgtgcaaatgcagtcgggtttatgatcaggactgcccttatctataaagctgctaacccccgagccttgaagggaaaagataaacaccagctgccagtcttttggttgtacaacaagaaggcctggacaacgagaaccctttttctggattggttccatcgatgctttgtccctgaagtcaggaagtaccttgccagtaagggactgccttttaaagttcttttgatattggacaatgcccctggccacccagaaccccatgagttcaacaccgaaggcgtcgaagtggtctacttgcccccaaacacaacgtctctaattcagcctctagatcagggggtcataaggacctttaaggctcattacacacggtactctatggaaaggattgtcaatgctatggaagagaaccccaatagagagaacatcatgaaagtctggaaggattacaccattgaagatgccatcgttgttacagaaaaagccgtgaaagccatcaagcccgaaacaataaattcctgctggagaaaactgtgtccagatgttgtgcatgacttcacaggatttacgacagagccaatcaaggaaatcatgaaagagattgtggatatggcaaaaaaggtggggggtgaagggtttcaagatatggatcttggagaaattcaagagctaatagacaccacaccagaggaattaacagaagacgacttgatggagatgagtgcttccgaaccagtgccagacgatgaggaagaagacgtagaagaagcagtgccagaaaacaaattgacattagacaatctggcagaagggttccgattattcaagactgcttttgacttcttttacgacatggacccttctatgatacgggcactgaaactaaagcaaacggtggaagaaggattggtaccatatagaaacatttttagagaaatgaaaaagcaaaaaagtcagacagaaattacgatgtatttccataaagttacaccgagtgtgcctgcctctcctgcctccccttccacctcctccacctcttccgcctctgccaccctgagacagcaagaccaacccctcctcttcctcctcctcctcagcctactcaacgtgaagacgatgaggatgaagacctttatgatgatccacttccacttaatgaatagtaaatatattttctcttccttatgattttcttaataacattttcttttctctagcttactttattgtaagaatacagtatataatacatataacatacaaaatatgtgttaatcgactgtttatgttatcggtaaggcttccggtcaacagtaggctattagtagttaagttttkggggagtcaaaagttatacgcggatttttgactgcgcggggggtcggcgcccctaacccccgcgttgttcaagggtcaactg

SEQ ID NO: 150 - DNA, 2302 bp, Homo sapiens
  repeat_region (1)..(2302): trigger5
cagatggttcccaacttacgatttttcaactttacgatggtgcgaaagcgatacgcattcagtagaaaccgtacttcgaatttctgatcttttcccaggctrgcgatatgcggtacaatactctgtcgcgatgctgggcagcgrcagtgarccgcagytcccagtcagccgcgcgatcacgagggtaaacaaccrrtaytctacagtgtaytrtrtgactggcgtttcttggacattgtgtttcgcgcttttgcatcctgtcatgtctacagtatgctcatctatgcctcctgcttctggtgagaagaagaggaaggcaattactcttgagatgaaactcaagataatcgccctgcatgaagacggcaagggattaatggccattgcacaagagttgggactttcacgatccatgatcctcaaccatcttaaagaataagaagtgaatcagtgaggcagtgaaatcgtcagcattagttaaatccactgtcacgaagaaaagagcttggctgattgataatatcgaaaaattacttgtcatgtggatgtaagaccagatatcgaagggcatactacttactgatgatgccagctagggcaagaagtgtttttgattacactaaaagagtgaatgaatgtgtcgatgatcctattatacacaagtgtttatggcaagtcataggtgattccagtgcttcaaaaggcatcataattttcttaatgtgaaggtcagcagagagtcagcaagcgctgatattgaatgtgtcaaagcttttaggaagagctgtacacgataattgtggataataaatatttcccaggacaaatattttatgtaaataaaatagggttgctctggaagcaacctgtcaagaacttaaggcattcagactgtgtattgctgcttttgggtggaaatgttgcagggttcaaattaaagcttttcctaatttacaactcagggaacccaagaacactcaagaatgtgagcaagcattcgcttcttatttattatcaccataacaagacaccctggaggacctcagcattgttcgaagactggcttttgaactgttttcttccacaggcaagagaatattgtaagcaaaaaacgacttcattcaagattcttctgatcttagacagtgctccagggcacccacagcatataggtgacatgcattcttatggaaagttatgagtttgctgccaaacacaaccacactcaactcatggaccaaggcacaatagctgcattcaaagcacactatgccaggcatttgctccggctgttgaagtgaatgaatctggctgaatgctcctagagttctggaaaagttttaacattctaaatgctatccagaatatcactggagcatggaaagaagtcacacagcaatgcatgaatggcatttggaaaaaagttttgaagacatgtgaacacattcaaaggccttagcaaggttctgctgttgatgaaacagtaacaagatactagtgcttggagaatagctagaattgatgaagaggatatttattaacttcttggcattgaatctgaagagctttccaatgaggagataatcaaactggaggaagaaagaagttgagaaagaggaagaagttatacctgaggcaccaagaaagttaacggcaaagaaactggcagagatatttgccactatcagcagtgccattcagaagttagaagaaagggatgtcattattcacaggagctgacacacagtacaggatgctcttgcttgctacagagaaatatataatgaaaaggagaacaaactgtatagtccaaacctgatgtcttcctgaagaacactatgcctgctaaaccattaacaagtatcgatgccccagtgccttctcccagctactctcaggcctcatcagaagagaaattaatgaccctgttgcagtagcatccccatcatccagcaattaattttagttcaatgcttcaaacattcttcaggcccagtatgcattcacctgtgtatgttacttaattgtgagtacccatacaaccatactgtttytyactttcagtacagtattcartaaattacatgagatattcaacactttattataaaataggctttgtgttagatgattttgcccaactgtaggctaatgtaagtgttctgagcatgtttaaggtaggctaggctaagctatgatgttcggtaggttaggtgtattaaatgcattttcgacttacaatattttcaacttacgatgggtttatcgggatgtaaccccatcgtaagtcgaggagcatctg

SEQ ID NO: 151 - DNA, 2806 bp, Homo sapiens
  repeat_region (1)..(2806): zombi
caggttgagcatccctaatccaaaaatccgaaatctgaaatgctccaaaatctgaaactttttgagcgctgacatgacgccacaagtggaaaattccacacctgaccttatgtgacgggtcacagtcaaaacgcaggtgcacaacacacagtttattcggcgtccccaagggaaaaaagaccctcccagcccccttcagctgcggtatatcttttccgcgcacacccagattcccccatgcaagcacgcccacaaagggtaataaaatggcacgtgtgcaggctggacacaccaacggcaggttccccacaatgcccccacatggggtcaagacctacgtgcattactcactgtgtttttttgcttattctctgctctgtggtgtaaagatattgttgaaaatgtcaaaaaggcctgtagatacccctgtgagtaacaatgataagaaaaaggaagcatttatgtttatctatagcacagaaaagtcaagctgttggagaaactggacagtggtgtaagtgtgaaacgtcttacagaagagtatggtgttggaatgaccaccatatatgacctgaagaaacagaaggataaactgttgaagttctatgctgaaagtgatgaacggaagttaatgaaaaataaaaaaacactgcataaagctaaaaatgaagatctcgatcgtgtattgaaagagtggatccgtcagcatcacagtgaacacatgccacttaatggtacgctgatcatgaaacaagcaaagatctgtcacaatgaactgaaaattgaagggaactgtgaatattcaacgggctggttgcagaaatttaagaaaagacacggcattacatttttaaagatttgtggtgataaagcatctgctgatcatgaagcagcggagaaattcattgacgagtttgccaagatcatcgctgatgaaaatctgatgccagaacaagtctataatgctgatgaaacatcaccgttttggtgttattgccccagaaagacactgactacagctgatgagacagcccctacaggaattaaggatgccaaggacagaataactgtgctgggatgtgctaatgcagcaggcacgcataagtgtaaacttgctgtgataggcaaaagcttgcgtccttgctgttttcaaggagtgaatttcttaccagtccattattatgctaacaaaaaggcatggatcaccagggacatcttttctgattggtttcacaaacattttgtaccagcggcttgtgctcactgcagggaagctggactggatgatgactgcaagattttgttattccttgacaactgttctgctcatcctccagctgaaattctcatcaaaaataatgtttatgccatgtactttcccccaaatgtgacttcattaattcagccatgtgaccagggtatctttagatcaatgaagagtaaatataaaaacactttcttgaacagcatgctagcagcagtgaacagaggcgtgggtgtggaaggttttcaaaaggagtttagcatgaaggatgccgtatatgctgttgccaacgcttggaacacagtgactaaagacacagttgtgcatgcctggcacaacctctggcctgcgactgtgttcagtgatgatgatgaaccaagtggtgactttgaaggattctgtatgtcaagtgagaaaaaaatgatgtctgacctccttacatatgcaaaaaatataccttcagagtccgtcagtaagctggaagaagtggatattaaagacatttttaacatcgataatgaggctccagttgttcattcattggaagaagtggatatcaaagaagtcttccacatcgataaatgcattaccagttgttcaaccatcaccggatggtggaatagccgaaatggttctgaatcaaggtgattgtgatgatagtgatgatgaagatgatgacgttaacactgcagaaaaagcgcctatagatgacatggtgaaaatgtgtgatgggcttattgaaggactagagcagcgtgcattcataacagaacaagaaatcatgtcagtttataaaatcaaagagagacttctaagacaaaaaccattgttaatgaggcagatgactccggaggaaacattttaaaaagccatccagcagaatgcctcctcatccctagaggacccacttcctggtccctcaactgcttctgatgtttcttctcacttagaaaacaaaaaccaaaaagcaaaaaaaatacagtgtacagtaaccttttaatcaaaacacagcatcgtagatggagactgaaagcctgccattgtttgttgttgctgttgtttaacagctgatacaggtattctggtgatgctactgtgctgcttagttaccctgaacacatttttttttcactgtattaatggtatgtcatattttttactgttaagtacttatgtgtgaataagtgtaagaaaatgattgcttatcggtagcatataaattcagagtcaggaatgatggtgatgccaaacaaccacagattgtccacatgggtggctgagatagtgacacctttgctttctgatggttcaatgtacacaaactttgtttcatgcacaaaattattaaaaatattgtataaaattaccttcaggctatgtgtataaggtatatatgaaacataaatgaattttgtgtttagacttgggtcccatccccaagatatctcattatgtatatgcaaatattccaaaatctggaaaaaaatccagaattcaaacacttctggtcccaagcatttcggataagggatactcaacctg

SEQ ID NO: 152 - DNA, 234 bp, Homo sapiens
  repeat_region (1)..(234): zombi_a
caggttgagcatcccaaatccgaaaatccgaaatccgaaatgctccaaaatccgaaactttttgagcgccgacatgacgctcaaaggaaatgctcattggagcgttttggatttcggattttcagatttgggatgctcaaccggtaagtataatgcaaatattccaaaatccaaaaatccgaaatccgaaacacttctggtcccaagcattttggataagggatactcaacctg

SEQ ID NO: 153 - DNA, 468 bp, Homo sapiens
  repeat_region (1)..(468): zombi_b
  misc_feature (145)..(147): n is a, c, g or t
  misc_feature (149)..(149): n is a, c, g or t
  misc_feature (153)..(154): n is a, c, g or t
  misc_feature (157)..(157): n is a, c, g or t
  misc_feature (159)..(159): n is a, c, g or t
  misc_feature (166)..(166): n is a, c, g or t
  misc_feature (169)..(169): n is a, c, g or t
  misc_feature (177)..(177): n is a, c, g or t
  misc_feature (182)..(182): n is a, c, g or t
  misc_feature (187)..(187): n is a, c, g or t
  misc_feature (198)..(198): n is a, c, g or t
  misc_feature (200)..(200): n is a, c, g or t
  misc_feature (210)..(210): n is a, c, g or t
caggttgagcatccctaatctgaaaatccgaaatccaaaatgctccaaaatctgaaactttttgagcaccaacatgatgccacaagtggaaaattccacacctgacctcatgtgataggtcacagtcaaaayacaatcaagactnnncnagcnnctncngttgctnttnctgccagncaacnacagnttgtgcacctngntggcaraganactgacacatttgctttctkatggttcagtgtacacaaactttgtttcatgcacaaaattatttaaaatattgtataaaattaccttcaggctatgtgtataaggtgtatatgaaacataaatgaatttcgtgtttagacttgggtcccatccccaagatatctcattatgtatatgcaaatattccaaaatccaaaaaaatctgaaatccaaaacacttctggtcccaagcatttcggataagggatactcaacctg

SEQ ID NO: 154 - DNA, 333 bp, Homo sapiens
  repeat_region (1)..(333): zombi_c
caggtccacaatcccttatctacaattctaaaatccaaaaagctctgaaaactaaaagtttttttataatttgaaactcatttggcagcaaaacctgacctgaactgatatgaggctatttatagtctttatttatcccacttagtgtgaatattcatatatttcactgcagaaatattaatgtgtttgattatagggtgctgccccagaccccactgggggtgttatataatatatagtatatgcactatattacctttctaaaatctaaaaaattctgaattctgaaacacatctggccccaaggatttcagataagggattgtggacctg

SEQ ID NO: 155 - DNA, 290 bp, Homo sapiens
  repeat_region (1)..(290): mer35
gatgtggcgtttgagtggacacgggggaagaaacaagtaatatgaataacatggtgagacagaaagagttgtggacagagctgtgggaaatatgagagataaggagagagatactgaaaagagcgttaagagagatgaagatagggtgtctggcccatgaaggccctcgtgaagagcaatgctgaatagatgaatgaacctcaatgcccagcagtggtgggatgaaaaggggatcctgtgcagaaaccacactacccatcagagaagcaactctgctcgtttccccttga

SEQ ID NO: 156 - DNA, 693 bp, Homo sapiens
  repeat_region (1)..(693): mer39
  misc_feature (57)..(57): n is a, c, g or t
  misc_feature (63)..(63): n is a, c, g or t
  misc_feature (79)..(79): n is a, c, g or t
  misc_feature (83)..(83): n is a, c, g or t
  misc_feature (144)..(144): n is a, c, g or t
  misc_feature (151)..(151): n is a, c, g or t
  misc_feature (161)..(161): n is a, c, g or t
  misc_feature (193)..(193): n is a, c, g or t
  misc_feature (209)..(210): n is a, c, g or t
  misc_feature (230)..(230): n is a, c, g or t
  misc_feature (477)..(477): n is a, c, g or t
  misc_feature (610)..(610): n is a, c, g or t
  misc_feature (628)..(629): n is a, c, g or t
  misc_feature (659)..(659): n is a, c, g or t
  misc_feature (683)..(685): n is a, c, g or t
cataattccgggttctcagctcctataagccttgctgtttcctgagtgactaaaacnataagnatatcttttgttgaantatntggctttttgtccttggttcatgtagcagctttggaacagcttcagagcggtaaaggtganggacagncttttgttanaatgttggggcgctctaagcctcagaagcagncctcagraaacagaanntcattttctgaccttctctngccctctaatcwtymcccgcctttctgtcttrgrgctgsccgtaaagaaattwtctgacctatctcgtctgatwgtaggtcataagaccctcattccagaaggggtcccgccctatacccgggaggaaggaatgccgcacagakagaccaagaagaatacgaacagacaagccttgctgggttyccacacycagtytatkaccattagatcatwccccttttgtcyaatcacatttctgcgcagctntccattcttcatcaaatctaarcataaaaatagagttttccctgagtmtttgkgtcttcatttctgaaggctcycatgtcacataaaactttgattaaataaatctrttatgcttttctcttgctaacctrtnttttattataggagtgtnngccgtgacccttatgatgggtagggaaggnatcacacctttctgcccctacagnnntaatgccc

SEQ ID NO: 157 - DNA, 581 bp, Homo sapiens
  repeat_region (1)..(581): mer39b
  misc_feature (321)..(321): n is a, c, g or t
tggttggggctcagaaaacaataccgcaaaatgaaggcctcagaagcaaartttttctctgaccttctcccgccctcctgtctctcagtcccattctcccctccccgaggctagccatagaaactagaatctctcttccccaaggcaggtcatagaaaccagaacycctttcctscaaagccagccataaaacctaaaaatattactctaactttccctccacctttctgtgtaaaaactggccataaagaaattatctgacctaccttgtttgattgtaggtcataagacccccattccagagagggccccgccctatanccggaaggaatgcgtgctcagagaagccaagaagaatctagacagacaggccttgctgggtttccccactcagctcattagcattrgatcatrgcctttttgtccagtcatatttctacacggctgtccattctttgttgaacctaagcataaaaatggacaattttccctgtatctttgggtcttcattctgaaggctcccgtgtatacagtgtatacatgttarataaatgtatatgcttttctccattattctgctt

SEQ ID NO: 158 - DNA, 554 bp, Homo sapiens
  repeat_region (1)..(554): mer41a
tgtcagagacgtgtgaaccagagcaactccatcttgaataggagctgggtaaaatraggctgaracctactgggctgcattcccagacggttaaggcattctaagtcacaggatgagataggaggtcggcacaagatacaggtcataaagaccttgctgataaaacaggttgcagtaaagaagccggcyaaaacccaccaaaaccaagatggccacgagagtgacctctggtcgtcctcactgctacactcccaccagcaccatgacagtttacaaatgccatggcaacgtcaggaagttaccctatatggtctaaaaaggggaggcatgaataatccaccccttgtttagcatatcatcaagaaataaccataaaaatrggcaaccagcagccctcggggctgctctgtctatggagtagccattcttttattcctttactttcttaataaacttgctttcactttactctrtggactcgccctgaattctttcttgcacragatccaagaaccctctcttggggtctggatcgggacccctttcttgtaaca

SEQ ID NO: 159 - DNA, 635 bp, Homo sapiens
  repeat_region (1)..(635): mer41b
tgtcagaggcgtttgaaccagagcaactccatcttgaataggcgctgggtaaaatraggctgaracctactgggctgcattcccagacggttaaggcattctaagtcacaggatgagataggaggtcggcacaagatacaggtcataaagaccttgctgataaaacaggttgcagtaaagaagccggcyaaaacccaccaaaaccaagatggccacgagagtgacctctggtcgtcctcactgctcattatatgytaattataatgcattagcatgctaaaagacactcccaccagcaccatgacagtttacaaatgccatggcaacgtcaggaagttaccctatatggtctaaaaaggggaggaaccctcagttccgggaattgcccgcccctttcctkgaaaaytcatgaataatccaccccttgtttagcatataatcaagaaataaccataaaaatrggcaaccagcagccctcggggctgctctgtctatggagtagccattcttttattcctttactttcttaataaacttgctttcactttactctrtggactcgccctgaattctttcttgcacragatccaagaaccctctcttggggtctggatcgggacccctttcttgtaaca

SEQ ID NO: 160 - DNA, 554 bp, Homo sapiens
  repeat_region (1)..(554): mer41c
tgtcagaggcgttcgaaccagagcgactccatcttgaatgagggctaggaaaatgaggctgagmcttgctgggctgcattcccagraagtcaggcattcctaacctctagatgtttacggttaagggaacagattaataatgtttactaaacagacccagacttgggagtgtccagatatcccgatatctkgagaacagaggcattcctaatttckctttaaagataataatattgattcttgcaaaakatagtaattaagcaaagatkrrcaatcctttgtcacaagcccttgtagcagagcacatctcccccgtaatgttctttggctttgttatcctatatataaacaagcattgtacctagggtggacgcsttcctcctsttgctttcgggaacgccctgctctgtctatggagtagccgttctttcactmctttactttcttaataaacttgctttyactttacactgtggaatcaccctgaattctttcttgcatgagatccaagaaccctctcttggcggttggatcaggacccctttcttgtaaca

SEQ ID NO: 161 - DNA, 557 bp, Homo sapiens
  repeat_region (1)..(557): mer41d
  misc_feature (407)..(407): n is a, c, g or t
tgttagggaagcaggagcctaggagagccagagtgacaccattttaaaatcaactccatcttaaaactagcaaggcacattccttgccagtcacgacccatggtcctaagatgtttacagttgaggaagcagcttgawaatacctacaaggacacactcctacaacaacagaaagtccagatgtcccaatacccataacaatatatgctttcaagataattatagtcatgctttgatgtacttacgcactaaaatgtcaaagatagttttctttaaatcaatatamtaataaattttgtcatgctgtcagcccacccgcacgtaggcacagcttagtttagtctttacatagacaagactcctatataagaaaagtttaagacagagatggcgcgttcctccgcctnctttccggggacgccctactctgtaatggagtagtttttaataaacttgctcttctcactgtactccgcaactcgccttgaattccttcctgtgcgagatccaagaaccctctcttagggtctggatcgggacccctttttctggtaaca

SEQ ID NO: 162 - DNA, 512 bp, Homo sapiens
  repeat_region (1)..(512): mer41e
tgaaatagctgcataagctatgggccgataagaccctgaaaaaccagggtgtggaccaagctggctaagactgactggacccaacatggtgctggatttgacctaggtttcacctaggacctcattatatgctcattaacatactaaatcacacacccaccagcaccatgacagttccgggaacacccatatttggtgtaaaaatgggtggcaccacagttctgagaaatcttcacctttttccaggaatcttcatgaatattccaccccttggttaaagaaacccataaaggtagaagccccaaacccymttggcgcaactcwctctcttgagtatgcccgcactcccctttcttgagtgtgtacttttcgctttgcaataaatctccgtactttcactattttctgactcatccttgaattccttctcgcgatggtgtcaagagcctggacaccggctggggtcgasgtcccaccggcgtttggggacctcccccagcccaccggtatca

SEQ ID NO: 163 - DNA, 3943 bp, Homo sapiens
  repeat_region (1)..(3943): mer41i
  misc_feature (855)..(855): n is a, c, g or t
  misc_feature (988)..(988): n is a, c, g or t
  misc_feature (1113)..(1113): n is a, c, g or t
  misc_feature (1197)..(1197): n is a, c, g or t
  misc_feature (1465)..(1465): n is a, c, g or t
  misc_feature (1473)..(1473): n is a, c, g or t
  misc_feature (2318)..(2323): n is a, c, g or t
  misc_feature (2617)..(2617): n is a, c, g or t
  misc_feature (2941)..(2941): n is a, c, g or t
  misc_feature (2993)..(2993): n is a, c, g or t
  misc_feature (3136)..(3136): n is a, c, g or t
  misc_feature (3408)..(3408): n is a, c, g or t
  misc_feature (3413)..(3413): n is a, c, g or t
  misc_feature (3421)..(3421): n is a, c, g or t
  misc_feature (3518)..(3519): n is a, c, g or t
  misc_feature (3650)..(3650): n is a, c, g or t
tctttctggcaaccacagaagggactacagtgcagaaaccctcaacccaaaggctaactttgagtaagtgatagggtcctgtaacatctttctggcaaacccaaaaggacaatactgaagaaacctcccaatgcaaaggaaatagactacatcattgataggccgaccttgggcaagtggtggggtacccaggtaaaagatgggattgggttagaggcccaatttagggaagtttgggtctctgctaagacagactgggttaaaggcccctcttaataaatggcaaggatgcttgaccaaacttggtttagagggccaacttaggagggttagagtccttcctaagatttaaggggttagaggcccctctcagtaaagtccctcatggttaagaacgggtttggcactaagggatgttaactgccattctctttggattaatctgtgttgcactctttgctgatggctatgggtgacaggattaggcatgtgatcctgtgatcacgggacatgaggagctttttcttccctaaaaggggaaacttcagagctgctgggcctgctggaaaagatcccttctcaactgacaagtgaccgcctgaacttttgattcagtgtctgctgcaatgggcaggtctttctctggtctccctgagcgccttgccttccccaccctgccataagcagtgcttttctcccttccctttccyctctctstctgtgcaaaccggttaaacraacgataaaaatcactgtttatctcctctgtaaagttttrattaatrgaaaaaaggatttttgaggctagtcttaagctgtagcgaatctggtgtrctttgtgtgtctttctgtatngttctgtcataaaraggggtaccttaggatagaacgcwggctkaggacmcycgtaagctcactgttcaacccagcccagcaaactggtcagttataaattttgctgcaggtccctgaaacaacaacaaaaaantggatgaggtttccctcccatcttgttttatgtccttggragcttgaccttgtaaccatgtggcgrtrctttcgcttggyctctgccatcacaatggcgtcccgggttcaggrttcwattcctgnctcagrrgatgagtttctttatattcttctgtctatgtatttatatgtgttgtgtgtrtgtgatgtttatatatraaagagctntrattaattggcttaaaraataagaagagcttaaatcaaatattttgtcagaaaartaraargtstartgccttttagttcacgtgactttagtaatctttgrkaaataaagacagtttaaagattattgrtaaaataaaaatgtcttcaaaayttaatktaracatttggtctraattagrcaggtcagatactatstctactagatgytttaaggtcataaactgcttctatgacttttgataatttttyaacttgcytgctttanagccattngattctaggtaaggcctggggacatgtggagttagccacgtcccctagctatgctggagagtcagactttatctgcgcttctgcctggtgtgtccaaggctaggctccacacctagtacataattaaaatcacttactaaccaggtttttcaccaaaagtaaaagttcttaagagttaacattgtaacatgtaattaagactactaaagaaacagttccacaagtaagtcctataaggaaagtgaaatgtgtttttggttaaaaaaaaattataagaagtcacgggagtatgagttttctttactttgcctaaagggttagaggattattttaagttagatagaataaagctgaaggtttaagcaagttgtggaaggtttatttaaaaaattaattgtaagagattttgtgtgtgaatatattggctaaagttgaaaaggcattattcagtttttccataaattaaacattggaataaaagcaaaacaggtttttgttagagcaaaaacctgcttatgacctgctttttaacaaacatttgtaaaggattataaaaggtttatgagaatgttaccttatggtcaaacattaaaattgggtagatatgtctataaggttttattaagaattgggtttgacatcaataatacactaatgcaacagtgacatttggctgatttagtataaaagtcatagaggaagcatcatcaaatatgaaatggtgtttggctttctttgggctgtatttgtataaatgtgtcattggtacatgttccaaaattattttaaaaaaaacttctttaaccctgatatgacttagtgtatgctattaataattgttatgnnnnnntaaattattgcgtgccacagaggtaacaaattttccttgtcaattgtgtctttaactgtggctgtcctaagactttttgtcatccatagacaattgttgtcttgttttggtcctctttagaaggtggtttataatcagctgtagaactctaacaggtgctcttaaatgcaggtttctgataactttggagattgtgacattagaacggaggaaaaacattcaggactcatgaagagctgaaatrttcatgaatatcaagcagaacagggagttaactgcatggactgaactaanagaagtctaacgtgtaaaacgttgctgatcctttgttttgtttttcagagtcaaggaaactttttcttttgagctatttacagcttttagcaattgagtaaagtatactyctgtgaacaaaatttggagcatrtttgtttctctctacctgatttctccagaatttggaaactattcgtgagtattctcaatttatggcaatatagttatttgcataagtgcaataagaatctgttytctttagtaacaggacacaattggagaaattggttattttaccaaggctttgactggaatggcatacttccctttaaggaatcaaanttgacttrycgagccgataaaagccccttggggaatctgrcctcataccttnttcayacgcagtccctgtacagggttcctgacctgtggtaagtaaagaatgtcactttctracaggcccagrarccccaagttatyttgrgacctcaagaggagaggaatttacycaactcataggtatttgakggtacaaanccatggctgggctcagctttaaaaaagtcttatccgagattccttctatgaaacaaagttccatcaaagccaattttaaaagcctatgtgaaaaataattattcttgctgcactktatacaaataatyaggccaagtataataaarcaaaycggtcctaccatgatttgtctttaryaaaaatggraaactggagagagaaaaattatgtttcaaaacctatagtacacytgttgttarattctartcttrcctaatgtttttcagttkttnttatnttctrcantttagactaactctacttattcctgtgaaccaaccagtgatctctggctgcwgctcagaagaaacaagrartgatgggtaatataaaaatccggatnntattctaattctgggcacgtattggaatcggctaacaaccccatatcagcttggttccaatagttgcccagttcatggaaagccttctaatttagtttacttgggataattttgcttattttgctttactnttgtggaatatattgctgttgtactctttgtgtaggaatgcaggataagcttactraatgttttcttaaaycgaacccttattcctcttccagggtaccatcttttgttgggaactcagttacaaataaccctcaccataccagtactttctggaatgagctcctcttctaccctggagggcaagagaccataatagtcaggcagaaatatcattgcccctattcagcctgaagaagttacagaagatgaatctttgtccttctacaaccttaggattaagggttcttttata

SEQ ID NO: 164 - DNA, 333 bp, Homo sapiens
  repeat_region (1)..(333): mer44a
cagtagtccccccttatccgcgggggatacgttccaagacccccagtggatgcctgaaaccacagatagtaccgaaccctatatatactatgttttttcctatatatatatacctatgataaagtttaatttataaattaggcacagtaagagattaacaataactaataaaatagaacaattataacaatataccgtaataaaagttatgtgaatgtggtctctttctctcaaaatatcttattgtactgtactcacctattttcggaccgcggttgaccatgggtaactgaaactrcggaaagtgaaaccgcggataaggrgggactactg

SEQ ID NO: 165 - DNA, 719 bp, Homo sapiens
  repeat_region (1)..(719): mer44b
  misc_feature (160)..(160): n is a, c, g or t
  misc_feature (263)..(263): n is a, c, g or t
  misc_feature (502)..(502): n is a, c, g or t
  misc_feature (689)..(689): n is a, c, g or t
cagtagtccctccttatccatgggggatatgttccaagacccccagtggatgcctgaaactrtggatagtacygaacyctatatatactatgttttttccyatacatacttatgataaagtttaatttataaattaggcacagtaagagattaacaatantaactaataataaaatagaacaattataacaatatactgtaataaaagttatgtgaatgtggtctctctctcaaaatatcttattgtactgtactcacccttnttcttcttgtgatgatgtgagatgataaaatgcctatgtgatgagatgaagtgaggtgaatgatgtaggcattgtgatgtagcgttaggctactattgaccttctgatgtctgatgatatgtcagaaggaggatcatctgcttcaggtgatcctggatcattgagccatgacaatgtcgatggttggatgtcaggagcagacaatgtcgatgactaatgggtggrtagcatatacagcntggatacgctggacaaagggatgattcacgtcccaggtrggatggagcaggacagtgtgagatttcasccatcatgctactcagaacaatacacaatttaaaacttatgaattgtttatttctggaattttccatttaatattttcagaccacagttgacyatgggtaactgaaaccacagaaagtnaaaccayrgataagggagaactactgtaca

SEQ ID NO: 166 - DNA, 728 bp, Homo sapiens
  repeat-region (1)..(728): mer44c
  misc_feature (523)..(523): n is a, c, g or t
  misc_feature (640)..(640): n is a, c, g or t
cagtagtccccccttatccacgggggatacgttccaagacccccagtggatgcctgaaaccacggatagtaccgaaccctattgctatcagtcttttggaacatgtttctgttcatgtcttctgcccacaaatttaatgcctcttccacctcaactaaacacgtatcatgcactccggccatcacttttgcagtttgaggtatgacatcaaaactagcatgaatttatttttccttcttcacaattccaaagatggaagattctttcttaccgtagatcttagcaacctcagcatacgattatttttcytttctttttaagtcaagaactttcaccttttcgcttaaaggaagcactttacagcttctytttggcatgtccgaattgccaccaacactactcttgtgcttttgggccattattaagtaaaacgggagttacttgaacacaagcactgtgataccaagacagtcggtctgataactgagatggctactaagtgattaacaggcaggtagcgtanacggcgtggatacgctggacaaagggatgattcacatcccggatgggacggcgcgaaatttcatcacgctactcagaacggcgcgyaatttaaaacttatgaattgtttatttctgnaattttcaatttaatattttcggaccgcagttgaccacgggtaactgaaaccacagaaagtraaaccacggataaggggggactgctg

SEQ ID NO: 167 - DNA, 178 bp, Homo sapiens
  repeat_region (1)..(178): mer45
caggaccggctacataatttgcgggrcccagtgcaaaatgaaaatgcggggccccttgttcaaaaattattaagaatttcaagacggcgacagcagagcattaaaccaagcacggggcccttctragcgcggggccctgtgtgactgcacaggtcgcacgcccatgaagccggccctg

SEQ ID NO: 168 - DNA, 1037 bp, Homo sapiens
  repeat_region (1)..(1037): mer45b
  misc_feature (495)..(495): n is a, c, g or t
caggaccggctacataatttgcggggcccagtgcaaaatgaaaatgcggggtcccttgttcaaaaagcaggaaaaagtgccattaaaggtactaaaatataaagctttttcctttcttccgtagtctctctctcgacttgtcatggtgtttttatatttgctatttaatgtcattctaagtaagaaaaattaaaattttaaattattagcatgaattttaccattcatctttatattgtgcaatgccagttttaaatgcaaatataagagcatttaactcgtatgcggaatcaccgaaattacacaatttgtattttatagctcgtacatgcgtatgtatttcgttcttaccagaacagtggaaacgctgcacaaaactaactcaactgtttttatttcacttcttgatacgcgcacattctaccaacactctctacctttggcttactgatgagtaaggaaggactgaaaggaaaaggaactataggttgsccnatctttccctttccttctatgtcatcattttcagcgtaagtggttggctaatacagagaagtaacacgagtaagaaaggatatgacagggttccttggtcgttcgtgtttcttagaatgccattgccttctttctgtgttcgaagcaagttctagtttgaatggaaagcgtggcctctcggggctgtcagtgccccgcttactcagtcgtrgatgtaacacgcttaccttgtacttgctttgagtctcgctgaactcccacgcattgtgggyccaccggaattctgtgctcatggggcaycgcgaatgctatatgcaaatggggcggcaaggaacggcggacacacatattgcgcgtatctcctctgctcacacacatgctccattgtcccatcagacttcacttacaaaacacaagttcaaagataaaattattaagaatttcaagatggcgacagcagagcattaaaccaagcgcggggcccttctgagcgcggggccctgtgtgactgcacaggtcgcacgcccatgaagccggccctg

SEQ ID NO: 169 - DNA, 953 bp, Homo sapiens
  repeat_region (1)..(953): mer45c
  misc_feature (324)..(324): n is a, c, g or t
  misc_feature (387)..(387): n is a, c, g or t
caggaccggctacataatttgcggggcccagtgcaaaatgaaaatgcggggccccttgttcaaaaagcaggaaaaagtgccattaaagrtactaaaatataaagctttttctttcttccgtagtctctctctcgacctgtcatggtatttttaaatttgctatttaatgttcatgctccttcaggcacggggatattcactgggtcagtgcagaccctcacaggtgcccaggrggcctcaccccacgatttggcacgcscacacggcccaccagctgttaggttccccctcctgccagccactgggccgacatgccgtggcctnccgggagcggggaagtcgagccaggcatctctccttcccacgggcctactgccccagcccaangcggatgggtgattcccaagggactgcaactttcatgccggaatgtggtmggtgcctggatgagaggtggacgagaggctcgcccccgccaagtcacccgccaaatgtgctgtggcgactgccagttcagggcaggacagctgtcgccaagccccatcccgagataccacggggcatgcgcccaaccctgacccttcttgcacccgcgcccgggccctggttcctggcggaggcarggggcggcagtggtcgttgggcaagwctgtggagggagaaggcagggcaggtctggggcaccaggagstaggggagcgggcggccgagaacccgccccggggaggcggggaggcagcgggagrcgggactgcskgtgagcccaggctccaagcccccagcacatgctccattgtcccatcagacttcacttacaaaacacaaattcaaagataaaattattaagaatttcaagacagcgaccgcagagcattaaaccccaagcgcggggcccttctgagcgcggggccctgtgtgactgcacaggtcgcacgcccatgaagccggccctg

SEQ ID NO: 170 - DNA, 784 bp, Homo sapiens
  repeat_region (1)..(784): mer45r
  misc_feature (41)..(41): n is a, c, g or t
  misc_feature (52)..(52): n is a, c, g or t
  misc_feature (645)..(645): n is a, c, g or t
  misc_feature (651)..(651): n is a, c, g or t
  misc_feature (686)..(686): n is a, c, g or t
  misc_feature (716)..(716): n is a, c, g or t
  misc_feature (745)..(745): n is a, c, g or t
  misc_feature (761)..(761): n is a, c, g or t
caggaccggctacataatttgtgrgacccagtgcaaaatgnaaatgtaggancccttttcaaaaagcaaaaaaaaaatgccttaaagataataaaatataaaattttttttttaaaatattttaacttataaaatgtaatagggataatagtgatacataaataaattataacaacataaacttataaattgcaaaaaaattattttggtgtcataattttatataatataataaataataatactttattaatgtgatatcttgattgatccataaaatttttttggctcacttttctgcaaattcatttattaggttattaaaatttaaatacttttagcaacttcattttcaattgatataattgaaagcaacatcaatcactcttggcaaatgcaagattacaaataattttttataatttttaattttgagaaggatctttctgctgatgcaactgttactggagctgttaaragtattttatatgctgtgacaacattaggatacatttatgataaattattttaaaatataaattttattacatytatagatgatgattcttgtagaacaatttttctaaaaagatttaactcttcatacaaatcagttttatataagtctgaatttaatttaaattntaaatnttattgtaaatttatacaatgatattttaatgtanttcctctgattttctgtaacttgtggaggnttataagctgaaagtggcttcatgatttntatataattcaaaatncctatttatgcattctatcactg

SEQ ID NO: 171 - DNA, 398 bp, Homo sapiens
  repeat_region (1)..(398): mer48
tgwaagattctccccrgggcctgaaagcttraggggatgartaacccctcccttcctcaggcccagtcccaaggcgcaaggtcacttgtgccagcagtgtgcgccagcaagatagcagaagcaggaagagagccggccggaagacacgtacccccgaagatcgagaaagaggccatccgggtacaacgtagcagttacgtcagactgggacacttcctgtttacaggagactataaaaccyytgccccgtcctcacttggggctgacgccattttaggcctcagcccgcctgcactcaggcagcacccaggcgctcattaaaacagcgtgttgctccacacctcctcgtgttgttgtggacgcgctctcggggttsgaaccgayacaagarccttaca

SEQ ID NO: 172 - DNA, 923 bp, Homo sapiens
  repeat_region (1)..(923): mer49
tgtaaactaaaaataaaatcttaagccccccgccgactgaacggaccccctcttggccaaggggaccccagagaaaccttaaaaactgagttcccggccatgacgggatgggaggtcagacacgcctcattataccccctcccttttgtggtttagacacaacaactgaccagcattaatgttaaaatagagatcataagactgacagaacggactctttgtggcaataagataccaaattataaacaggacctaaggccatgccaggcaagggttaagtcacgcacccctacacttaaagaataaactatgttctaactgccacaaggtttttctttttctctaacagctaaacaagcactggcctcgagataagcaatattaaaacaattgcagctcatccascaccagacgctgactaactgaccccctgttccaccagccataactacagctttgattggacaagagactgatttcagtaactttctcctgataagagaccaccggccatggactggttctggccagtttacagaggctgtgcacttgcacgccttcgtgtcctgaaaasaccttttgacgtatagggcctaattgtaatacatttaaatgttaagtctccaccccaaagtgaacatgggtcgtatgttacatgcatgtttgttcaatacgcatgcgtcaggaccaccttcatgaatattcatagctcctcctgtaacctgttgaatatgtatgcttagccaacccgttcagcataaagctcctgccccaacccctcctccttcgaagtgcctgtctctggtcttggccagaggctacgcttcccagcctgcgggatggccaccttgcaggctgtaaccctttataagaaataaagtctcctttccaaatttatagatctcgtgatttttcagttgaca

SEQ ID NO: 173 - DNA, 660 bp, Homo sapiens
  repeat_region (1)..(660): mer4a
tgtgaaaggaaaataaatctcgggrccccmaaatcactaagccaaagggaaaagtcaagctgggaactgcgtyaggcaaacctgcctcccattttattcctaaataagatagctacaaagataaaaggctacatacctctctcacaatttycyacaaggaaattccttgcggacctcaagatctttaccctaaaacagttctgytgamyttcaccttggcawtgyaaatggrtacaggacaaaggtacagaactgaaagtcatccctctgctcacctgagacaaatgcatatctgattgcttcctctgccctattgtttatgtaaaaatgcagattcactgagccagactmaattgtgtattcagtgaaargctgatcarrgactcaaaagaatgmagccwtttgtctcttatctacctatgacctggaagcccctrcttcgagttgtcccgcctttccagaccgaaccaatgtacatcttacatatattgattgatgtctcatgtctccctaaaatgtataaaascaagctgtrccccgaccaccttgggcacatgtcgtcaggacctcctgaggctgtgtcacgggtgcgtccttaaccttggcaaaataaactttctaaattgaytgagacctgtctcagatacttttgggttcaca

SEQ ID NO: 174 - DNA, 611 bp, Homo sapiens
  repeat_region (1)..(611): mer4b
  misc_feature (193)..(193): n is a, c, g or t
  misc_feature (244)..(244): n is a, c, g or t
  misc_feature (293)..(293): n is a, c, g or t
  misc_feature (328)..(328): n is a, c, g or t
tgtaaaccaaaaataaaattctaagkcccccaaccgtctgaatggacycctcctctyggccaagggcaytccaaagytaacctgraaaactagttcaggccatgatgggaagtgggggtcggacacgcctcattataccytccyycttctggaattcaggcacaactgaccagcattaacatcaacacagacnttaagtctgataagaaacagtttacaayctrttctctctgaagcctgctanctgaargcttcatctgcacgataaaacttggtctccgcaaccccttatntcataacccggacattcctttccattgatctyaantcttcaaccarttgccaatcagaaaatctttgaatctacctatgacctggaagcccccgcttcgagttgtcccgcctttccggaccgaaccaatgtacatcttacatgtatttgattgatgcctcatgtctccctaaaatgtataaaascaagctgtrccccgaccaccttgggcacatgtkgtcaggacctcctgaggctgtgtcacgggtgcgtccttaaccttggcaaaataaactttctaaattgaytgagacctgtctcagatacttttgggttcaca

SEQ ID NO: 175 - DNA, 2454 bp, Homo sapiens
  repeat_region (1)..(2454): mer4bi
  misc_feature (4)..(5): n is a, c, g or t
  misc_feature (10)..(10): n is a, c, g or t
  misc_feature (23)..(23): n is a, c, g or t
  misc_feature (27)..(27): n is a, c, g or t
  misc_feature (32)..(32): n is a, c, g or t
  misc_feature (39)..(39): n is a, c, g or t
  misc_feature (42)..(43): n is a, c, g or t
  misc_feature (47)..(47): n is a, c, g or t
  misc_feature (59)..(61): n is a, c, g or t
  misc_feature (63)..(64): n is a, c, g or t
  misc_feature (74)..(74): n is a, c, g or t
  misc_feature (119)..(119): n is a, c, g or t
  misc_feature (122)..(122): n is a, c, g or t
  misc_feature (380)..(380): n is a, c, g or t
  misc_feature (419)..(419): n is a, c, g or t
  misc_feature (495)..(495): n is a, c, g or t
  misc_feature (1462)..(1462): n is a, c, g or t
  misc_feature (1683)..(1683): n is a, c, g or t
  misc_feature (1686)..(1686): n is a, c, g or t
  misc_feature (1688)..(1688): n is a, c, g or t
  misc_feature (1779)..(1799): n is a, c, g or t
  misc_feature (1782)..(1782): n is a, c, g or t
tttnncactnggaatttgggttnctanragtnaaaatantannagantaaaatgttttnnntnnagtttataangayatgaggatgtgktttttgttgaaaaaaatgtatttttgtctnagntagaagttatttaaaagttgtttcaaaataaagggaaaaaattatataaataaaaataaatgrataaagagaaaaataaaaaggtgggaaatgagaaacctttgactcctgggtggccahgtggtcacccatagtatagagctgcagctgdgctgtgttcagttactaaaggtaaaagttaccagtgaaatttagagatggatcatactcccagggagttggttcactggatgcataaggaaatgcaaactaataagncaaaaagcaaatatgcaatctcttggctattgttatctntaatagctaaaaaaaaaataaaagagtgctgggttgggtcttgatgctggaccaagctcagatgtvggtctgtctnagctcaggccactagcctcaaagctacccacaaaaagaaaaattaagccaggacaacaaaaggtacctctgagacctgtggttaccaagaagatagtcaatrtgggggaagggcaaaaccaagtaactattaaaaccagagggtataatgtaaaggaattgttccattttgtagattggtatcatcagcttcctgaaaaacctttactaaaatggattgtgagaataactaatttarggacagtatctttrrttttaaatgctgcagaatrgaagagcatgtttgggttgatgcaggaccctacagctcactattgaacaatcactgatgrgtatatgtgatccaaacacacaggaggttattcctgagagaacagccagcctagtggactggataaaagccactgtaaggtctgtttaccctgagaaggggactgcccaactctccctataaaatgccaagtgagagcaccccagatgaagcagctgatatgcttcatatgcaagccatgtgggactggctttatgatgaccgggatattcacccactgaatatgcctattacccaggtcatggtaaatgctggggttaagggggccccttttacatgggcaccccatgtaacattactcctgcagaatcaaacaactgtttaagaagccttatcaaatttgctgtccctcatgggtcttacagatgcttaataaaacattagawtaattaacaacaaaagaaaatggaaaaggaaaagggagtcaaaggactcaccccagaagsgtggtggaaatctttaaatggttattaagaaatggaataaattaaaattgatggggttaaaacaaaggtctttacaacactatcaaaggttgggtggaccaaagggagcccctgctggtcccccaacattaaagggccccaaactagttttctgtatttrctccagattggagaaatttaaaaaaaatcanaaggcaaagattataatgagaaagctgacattgcctggrgcaatgctgaggcaaatyaagataaagattgacaaaagggcctgagtcccttggctcaacyccctgctgggaacccaaatcctttttcaccagaaaaggtaaaatggtctgggagtagaraagaaaggttcctgggaccagaacataaaaatgtaaaggttgatataatgaaadatatacmnttntnaaagsttgaattataaaatttgaaatgtttaaacakyggctttatgtaaagtagttgtaactcctttacctaaatgtcttatgaaaatggntantgtatctaactgggggatgtttcccctatctagtactataaaacagaaggcatgtaaatctgccctttaagaaatgttaattggacatgctaaatgggaacyagtaagattgcctaagcccacagaatatagggtagaagctggagtgctagtmgggacaaatcctccacttcatagccctttgtggagcatttacyggggcttatggcaaaagcctgtgagtacttcccaatgacaacgactgagactttggactagagaatttccacttgaggggcatttactgccttgctatgggatgttaactgaagctacccctatgctaatgaaaataatggtgcccaaaagagttccatgataaaataaaaatggtttatataggatcttgctacctgggaatgyaaggaggagatactcatgagcagagagcctcttttcccctaggactaactctaactgtgtgaggagctgctagattctacagtgcctaataaacagctctcatytgacaagagctgcttggtttgtgaatggcagttccaaggtaaacaaacaacatcttgtttggaaggctgctgctctggttaaagaagagtcaagaaaatctttttcttttaagttatttatagtttagagcaattgggtaaagtatgtttttgtaagcaaatttac

SEQ ID NO: 176 - DNA, 465 bp, Homo sapiens
  repeat_region (1)..(465): mer4c
tgtgaaaggaaaataaaaacttgggaccccaattcactatgccaaaaggaaaaaattaagctgaaagctgagtcatgcaagaaactgcctttccttttgttcctaagcagatagctacagataaaaggttaaatatctccacaggtagctactctatgttcaccttatcttatgtaaagtgccgatttactgagcacgagacgaatacataattgactattcccctacctgctccttttctcttgcaacatgtggattcagtaatgtgaccataccctccctctttcccctccagcccgcttttcccctttaaatattgaagccctcaaaatcatctttggagaaaggcacagaccacagatgtttctgtgatttcgtgtttctttctcccgggcatgtccttaaccttggcaaaataaacttctaaattgattgagacctgtctcagatactttttggtttaca

SEQ ID NO: 177 - DNA, 1017 bp, Homo sapiens
  repeat_region (1)..(1017): mer4d
  misc_feature (214)..(214): n is a, c, g or t
  misc_feature (654)..(654): n is a, c, g or t
  misc_feature (890)..(890): n is a, c, g or t
tgtaaaccaaaaataaaatcctaagccccccaaccgactgaacggatccctctcttggccaaggggaccccaragaaacctgaaaaactaattcaggccataacgggaagtggggtcagacacgcctcattatagcctcctccctttggagttcaggcacaactgaccagcattaacattaaaacagagatcataagactgacaaaacagactntttgtagcaataagataccacgaggacgaagytctkatttttttatcttgcccaaattcctatgtaaggggtctagggagtcgcgccttacaaaccatgaattctcattagatgggttttattaaaccctgtatatcgtgacttaatttccaacctgactctggtatagcatcacatgacagatagcagaccctgaaggaaatcaaaatattttaccccaaaatatatttctttgacatattttgaaatggccctgcgaagctgtctcttgtggggaaaatctgcattctgtagagaatctctttccctttctaggtctttttccctgatccaggggagaataactgagagtctggcaccttttaaggtctgataagagaaawttaccatctattctctctgaagcctgctacctggaggcttcatctrcatgataaaanccttggcctccacaactccccttatcttcactcgattgatttcaaytctttagacagagcttaactctttcaaccaattgccaaycagaaaatctttgaatccacctatgacctggaagcccccgcttcgagttgtcccgcctttcckgrgcgaaccaatgtacaccttacatgtattgatttatgtctttgcctataagttccgtctccctaaaatgtataaaaccaagctgtancccgaccaccttggrcacatgttctcaggacctcctgaggctgtcacgggccatggtccttcactttggcaaaataagcctctatttaaattgattaaaatctgtctcggatattttttgctttaca

SEQ ID NO: 178 - DNA, 780 bp, Homo sapiens
  repeat_region (1)..(780): mer4e
  misc_feature (31)..(31): n is a, c, g or t
  misc_feature (404)..(404): n is a, c, g or t
tgaggactaagctctgatttttttttttttntttttatcttgcccaaattcctatctaaggggtctggggagtcatgccctacaaaccataaattctcatcagatgggttttatttaaccctatatatcgtgacttactttccaatctgactctggcataacattacgagacaaggaagaaaatcaaaatattttaccccaaaacatgtttctttgccatatcttgaaatggccctgcaaagctgtcctttgtgggggaaaatctacatctgtaaagaatctctattaacatagctagatctttttcttccaggccttcccaatcctgaagagattaactaagagtctagcaccttttaaaggtctgaataggaaacatttgtcatctattstctctaagggcngccactatgagacttcaaaagaaccttggtctccacaatcttttatcttaacctgaacatttcctttctattgatcccaggtctttagacaaactcaaccaattgtcaaccagaaaatgtttaaatttacctatagcctggaagcccccactttgagttgtcccgcctttctgraccaaaccaatgtatttcttaaatgtatttgattgatgtctcatgcctccctaaaatgtataaaaccaagctgtaccccgaccaccttgggcacatgttctcaggacctcctgagggctgtgtcacgggccatggtcactcatatttggctcagaataaatctcttcaaatattttacagagtttgactcttttcgtcaaca

SEQ ID NO: 179 - DNA, 6388 bp, Homo sapiens
  repeat_region (1)..(6388): mer4i
  misc_feature (731)..(731): n is a, c, g or t
  misc_feature (922)..(922): n is a, c, g or t
  misc_feature (2530)..(2530): n is a, c, g or t
  misc_feature (2879)..(2879): n is a, c, g or t
  misc_feature (4632)..(4632): n is a, c, g or t
  misc_feature (6128)..(6128): n is a, c, g or t
tggtaaccatggaagggattctgagtggagatgcccctgacctttgacaaatctcctatcggtgcttggtaccagcatgagctaactttatggcycaagctcaarwtrtctttatkgctcaaaccaataggacaatttgctgaggtctgrgagcatctccctccagagaatccctgatctcccaaaatttggtcgagatctaargtttattttgctgtacaactcctctttttttggagttttacttgcttccaacacaaggaaggcgagtttttcctgcttccatgatgatggaaggcaggtaactcctttmtggagtttsagctcgcttccaacagggaagrtgagttttttttcctgcttctaggatggtagagagcagtcttcagcctgagacccattcctaggtaagtaactgaattggggtttgtcttggaaattctccttcttggctaaaagttaagattaacaatcttggaaattctccttaargactaaaagttaagattaacaaccagctggtcttaatttctccttaccattagagcgctcagtaatcatataagttgtgcgatcatttgttttgcttaactgcttytgtttttgttgtttttgtttgtttctgtttttgttgttgtttcwgtctttttcctattgggtttgaccaactctatccgacttgatcagtgtggtggggggagaaaaacggccagcaaaaggaaaaaattgancttgtttactttgactactaaatctgaaggagaattccaaattatggggaacaaggcctctgaagtggctaaattcccacaaaaaaaaaaaaaaamaaaaaaaaaacaaggcyagctttttgctagccaggccaaactgaaagagcaatggctgtcaccycacgctgcagttcwatagctaaggtyctgcnttttttttttttttcaccgtgacagcctgggtttggttcytaaatcaagccctttctggtttgatasttggtacttctgaaatagcagcwgtttgtcctagctaaaatatggtaatgagatttkaaaggatttttttaaaggagctcaatggttaaaagtcagcttaattaaaaggctaacatccaagatgtatgtgtgtatgtgtgcgtgtgtatgtgtgcatgtgtgcgtgtttgtatttaaaaggccttcatgtttttgtttcgtcgtttgtttttctctcctaagaccttgtctttttttgagcaaagtttttttcttctcagttgactgaattctgttttcttcatttacttttcttccaccctgttcctccttccctttgccatcttykgyaccaagtgaarrgayctagaraaggcttctaatracttgagaccccttaaagaacwcagaaaaaggtgccacwcacccctttttgaggrtaaacttctgtttttccttatgggacctcaaaagtagtaaahagacagattcctctcaggtctaaagctctgctytcttttgyattgcgttacctgattttttgactaaaatagttattgcaacagaggctactcttgggtttttaaggaagagtgtagtgtagacacttagaaatgtctttgtttaaaaakttaagtrcactgtaaaagcatcatrtggyttagyctcatrataattctccctttttrgagacccagcattcagtgtgggctctgcccagagctcagtgrtccagttaaaaataggtagtctctatytaaataaaattggtctccttataaaatcctatgatagatttctataattttatgtttratttggcatcaatytttaatcttcctctagcaccaccagactttttctctctgtactttaagatgtaaattttgctatytgatttttcacctaagagttgtttcctttaatatgcaaatttagggctatttagctgacaactgcctagggtaatgaaacaggttatcaagaatttgaaagtctaagataggaaaaaaaggrggtcttataaatctataagatgtacttctatcagcatgcctaatacgtctatgtatttatgtgttgtgtacacaatgtttcactactaaaaatatataaaagagctctaattaattggcttaaagaaaaataaaagtgcttaaatcaaatactttatcaggaaaaaagaaaagactagtcaaatgctttttcaagttyatgaaatgctttttcaagtttatgtaacttaagtaaaatctttaataaataagctagctttaaaattattggtaaagtaatattagaaatgtcttaagaattgccagcatacatttttgtttgcattatattaatcaagcartttcatacttatccctgccaaatactataaaggtgtcaaaatttggcataggggttayaaaactataaacccagcccaaaacagaatgatctttgcttgtgtaatttttaataaataagacattgatattggtttaatgaaaayagctrcatcttgaatttagtaagattaccataacttctaaccttgtggctttaggcgrtyntttaaatgatgactatcgcagttttcataaataatctaggtaaacaattaataaaataattaggtaaatgtaatgggataaatacttgtagacaaacttgtcataatttagaatataaagttatattaaattaaataatagatawttwattatttgrgtattttccaataaaaatatattgtaggaaaacattcttkcttaaaaaaaagtgtgtcctttttaaaaaaatggtgaataagttttgtctaattcaaagcttatttaaaggttatrtataaaacaaggtaaaaggaaccaggaaataaaaaaaatgtaaagaaagttataaaaataaagaggtattttttgnargtaaaaaagctgaaaragaaataattttatatgagaaagaatcttatatggtaaatttatgagaaagaatcttgtatggtaaatttttgtcctaaaataaaatgactggtttttaagaaagaggwtgtttaggacaaatcagaaagtccaagcatgttatwaatggtctgtgtaagtcataataaggtttgcataaagagaaattaaaaaawtttatatgattaagttggctataattaaaagraaattatttataatagtctttctagagattgakgtttgatattaaaaatacactaatacactaaaaattkgttagaaaaacaaaattttcttaaagtattgatttaytcataaaattacaagagattttaattttaatccaaaaattcaacttttattgcatctcactgttttcaagctttttctcctctttgagaaggcctgagataataactctctccttcaacttttttgtcagctcctgtaattttttcctchggttctaactgytgttgtggcctgatgctaaaaatgttttatyttaaaggtctaaaagmaatgttttcttccaatataacattctgtactckkcttttcttgatgtgtctgaattgttccatgaaaccagaaaacttcactcataaccctggayacactcttccttgtctaattaattcaagtactattttcatcagtttgacttcaggttatctaaagggcttcccataaggagaagcaatcacactgcagaaggtttttcttttsctttttggtaactggcctaagaaaaagattttatgttttatcaagataatttttgtgttattattattaagtttttgatttgcttaggaaaactgagattaaaattttttaaattaaggttattacatccatgtatctttctgtattgcttttaaagtccttgtgacattgagttacagggctttaactcctgggtctaaaaaggacaccaagtcctgctaaatcttaaacactgacagcaattaaagccycatcttcaggcccgtagaagatgccaatcaaaataaactgcattcctgagacacaggaaattaaagctattcaactcctcaaggcccagggactatccagaagaggtgggcacgtgagattgtaagggccaattttgaaagataaaataagttcaragtttctctataaattaatcattaaaagtttctctataaattaatcattrawatcaaaggcacactgatgcaagaccagcatatgggcccctgtgtcagattaacaaggttttcttgaagcattaacckactccttaataaaggttgtaaaggttataaaaggcttatgraaattatatcttatggtcaagattaaaattttatagattgtttataaaattttgaaaaacaaatttaattggcttcatgctgtttttattagggcttattgtttggaaaattaagtctcctctctcaaagaatgaaggtttttgccttttttgaaatccttgagttatcactttggttaaatgaatgacttattttacaatgacctgtgattctattttgtgatatcaagtgttttaaacctttgatatttgacaaactttccaaaatcaaattataaattatgtctttctgacctaattaatcctttaagatattaggttccttaaagtccaaaaatgacataatttggcttatttggtacaaaaattatayaggaagcattgtcaaatatgaaaaatgtttaancytctttgggttrtatttgtataaatatgttattggtatatgttccaaaattatatgaaactcctataattctgatatrtcttagtgtatattatcartaataattataattattatgttaaattattgtatgccacagargtaaccaaatttcctcgtcaattgtgtctttaactatggctgttctaagacttttgtcatccacggacaattgttttattttgrtcctytttaaaaggtagtttataatcagctatagractctaacaagcgctcttaaatrcaggtttctgataactttggagattgtgacatcggaatagaggaaaaactttcaggactcatggararctaatgtgttcatgaggattgctaacccaacatcgagcaagcagaacaggaattaactgcatggactgaaccaatagaagabtgaaadaatctttttgactttttgcttaaaacgttgctgatcctttgttttgtttttcagagtcaagaaaacttttcttttgagctatttacagcttttaacaattgagtatagtatactcctatgaacaaaatttggagcatatttgtttctctctacctgatttctccagaatttggaaactatttgtgagtattcttaacttatggcaatacagttatttgcataagtgcaataagaatctgttttcatttgtaacaggacacaattggagaaactggttattttaccaaggctttgactggaatggtgtactttcctttaaggaatcaaacttgacttatggagccaataaaagcccttggaaaaactggcctcataccttgtbtacgcagtccctgtacaaggtttctgacctgtggtaagtaaagaatgtcactttctgacaggcccaggagccccargtttatcttggaacctcaagaggagaggaaattcacccaattcataggtatttgawggcgcaaatccatggctgggctcggctttaaaaaagtcttatctgagattccttctatggaaaaaagttccakcaaagccaatttaaaaagagcctatataamaaatmattattcttgctgcactttatgcaaataatcaggccaagtataataagastaaaacttattttrhaaacaaattggtcctaccatgatttgtctttagtaaaaatgggaaactggagagagaaaaattatgtttcaaaaactatagtatacctgttattagattctagttgtttttcaatttttattattttctacagtttggactgaattctaaattttttcctggctacaagtctccaaaataatgttttcaatactttttctttttttccttccwtttttcccatttttcctaatttaaaatcactraaaactaaagctgtgcttktcttaaagccctgcaaactgaarctagacaacttaaacttcagaagaaaataatagcaacctatttacatacataagccactttcatacctgcctactgatgtatngacttcagagtaatgtgrcctrtrtcaattttccaggattgttcttttgtttgttgttgtttttctcccttcctcctcctattttstcttcataggacatgagacttcacaacctgctaaaaatragctttcctaawawctcgggacctacccgtctaggaataaactatcctagccacgagagatcagacgaaacctgagaccagagactcattttcttctaaaatgctttctccaaaagattttagaaaagaagggaa

SEQ ID NO: 180 - DNA, 734 bp, Homo sapiens
  repeat_region (1)..(734): mer50
  misc_feature (47)..(47): n is a, c, g or t
tgttagagtaggtagctaggcagrcatgagcagggcaggagagggcnccccccacacacaccacgaatgtcgggtgaccatcaggtgatggtcaggcggttgttaaactgtctctctaaaataataattggtcacagccagcgccagggaaargcagtctcctaatagatagaaaacacctgaarctggtgatcagcagcttcccgataagatctcaggagttgggcgagtgagctcaagcatgcgcactaagaggcaaaatgrcggagtttaaccggcatatgaccttcctctaggaacactccaatggtaagggaaraatgcctcaartgagcatgtgcacaactccagtaaacacactgtgcatgcggcccytcccaagtgctggcaggccactgcgcacgcggacagcccaccccaaggaaaaatcaagggaggagraacgcaaaccccggaagcatgccgatgtataaaaccccaagtcaaaggtcaaaccgcgcacttggtctctcaagtcgcccgcttggccctcttccaagtgtacttcgcttcctttcgttcctgctctaaaactttttaataaacttycactcctgctctaaaacttgcctcggtctctttttctgccttatgcccctcagtcgaattctttcttctgaggaggcaagaattgaggttgctgcagacctgtacggattcgccgctggtaactcagataccttccaccggtaaca

SEQ ID NO: 181 - DNA, 1405 bp, Homo sapiens
  repeat_region (1)..(1405): mer50i
  misc_feature: n is a, c, g or t
tactttggtgccacgtgacttggatacgttccctagtggtaagagacctctatgcctcaccttctttggctggaggcgttcaacccccgtacgcggttttcttctcccctttcactctcctgcttactaaccaacccccagaacgattcctctcagccacagtggctctgctccccctggctgatctctcagctcaccctgacgggtggctcgcaggggtgggaaggaccttggagtccacaccgagtagacctgagacactaatggccctcctggacaggaggctcatgagagtggtagggctaaagcctaagaccgtgcaatgtctggggtttcctctgctttttcaactaaaattggctctttcccaaaaacccacaccgcctattctcctgttttctctgtgtgtgttctgaaatggccttgcgcacccgccggactgtccacctcgggggcaagtctgccttttctctgctttcactttgcatgccacgcgacttccttctctgccttaaacacacactccctgtttgttatttgtgcacccgcggctcttgctgcatttgcatggcagcaaagacacgggctcccttgtggatattccctgagatttatacttgtttttaccctaccagctcagatgacctccaacccttcctctgtctgttggctcattgccaggacagacactaatcggaaccccggctctgccagcttcttatgacttaccatatacttttcattcctgttatgccccagggccaagttttccggtggcttttgaagcagtttgtccgcctgcataggacctcactctgtggccctttaaggacctcacctacttgctttttttgagttagcactcctttgggaggagggaaaattcttcctttgccatttgcgagctcttatcccaagccccaagtcctccagaggttcctcctttatgtcaagagggcaaataaacgttgccctctcgaatccaagggctgctgtttttgcgagcatatgaaggctttccatgagtattcctcttgcttcctcccacttcctcctgtagcagagggattgtcctgtctgcttaagcatttgttctgcatgttaccccaggaggacaaggaaccccaaatacaaaattttctccattcctctaatcacttccatgcccttctcaatatgcatcaagaccttcaaggtcatattcgaagggagggaagtccagccccttgcggcagttagctgaaaaacaggcttctcatctacttaaagaacatgggaaatggaatatgagaaaaaaagagataatcattttgttgctagaatgctccaagtgagagtcactataaggtcatggagacaaggatataggctggcccaaggccgcaggcacaagagacaaagtacc

SEQ ID NO: 182 - DNA, 617 bp, Homo sapiens
  repeat_region (1)..(617): mer51a
  misc_feature (67)..(67): n is a, c, g or t
  misc_feature (75)..(75): n is a, c, g or t
  misc_feature (135)..(135): n is a, c, g or t
  misc_feature (135)..(141): n is a, c, g or t
tgaggcaggaaaatagggtctggaggcagggaacataaggccgattcacactgacttcctagaactnaatcaaanggaaaaccccaactttccacgtccamgtaacmaaaggaccagaggctactccctttrcannnnnnngatgaaaaattgaaagtacctctgattggtcccttcccgcaaccaatcaggctggtcgttggcccaagtcttcatttgcataggagtataactttgtaacttcacttcagcctctgattgatwrctttccgcaaccaatcagacgtttgcatagggtgtaactttgtaaytcgcttcagcctctgattggtcccctcccacaaccaatcagactgatcgtgggccacctcttcatttacatagggcgtaccccaagtaaccaatgggaaacctctagagggtatttaaactccagaaaattctgtaaccggggctcttgagccgcttgctcgagcccgctcccaccctgtggagtgtactttcgttttcaataaatctctgcttttgttgcttcattctttccttgctttgtttgtgcgttttgtccaattctttgttcaagacgccaagaacctggacaccctccaccggtaaca

SEQ ID NO: 183 - DNA, 371 bp, Homo sapiens
  repeat_region (1)..(371): mer51b
tgaggcaggaaaatagggtctggaggcagggaacataaggccgattcacacttcagctatgacaggaaatatcctctccatagggcataggccgagtaaatgactttgtaactttacttcgtcctcttcatttacatagggcgtaccccaagtaaccaatggaatcctctagagggtatttaaactcccaaaaattctgtaatggggctcttgagcccctatgctcgggcccgctcccaccctgtggagtgtactttcgttttcaataaatctctgcttttgttgcttcattctttccttgctttgtttgtgcgttttgtccaattctttgttcaagacgccaagaacctggacaccctccaccggtaaca

SEQ ID NO: 184 - DNA, 7816 bp, Homo sapiens
  repeat_region (1)..(7816): mer51i
tattttggcgagccagccaggaggaagaggtaagcccaaagtttgggattyatttttctccytttcctttctgctccatacaggggamtctctctctctcttttcctttccaacttgggacccttggtgggcagcgcctaaacatggaagcaactgcaggtttctggccgtggccagtgaaactaaggrgtttccatgtggagaagcctdaccaccactgcccggttcacttaagggacctgagtctttttchtttttcttttcctctctttvtttttcagtctttcagtggctgtttcctagtagctccttggaaattgagggcaattggctggggtcactccccagtactgcctgaaggcctaggaatgaatgggaataattgccctgccccgaagggggaatgrmwcttttwtttttttatcttttccgvgtgtggtccctgatccctacatgcggcacagctcagrgcaaactcacacgtgtttcaggkgacttaaaccttcttttcttatgctaaattcttcccttatcgtactcaactggctaaggaacaaaaaggcccacccagcatccagttcctatcattacagttcatggctatymctaatggaatggsaagcacgggaaagcgtggcgttatcaaattmtaagkatgctaraagktgrggccttcatcyaggkacwawwataaagctcatagtaggctctggagggaaagcatgcaaagtggcactggtgcccacctaaggtcagagacatctgacactctaagattggacccyaaagggggaktcccttggggatcctycagaccccaacctctccaaaacggawgcccttggcagaggtcctgaggtctagtwctaagccccccttagaattttctctmgsagttgcaatactgtgtggaccccmtattgtttggaatctgaagtttrctgttgaatgggaaagtgagacggcgttstatgtrtctaggcttttgtgctgcgtttctaagcagggggcctggtgaacgtgttataccttcctttggtaccgtttggccccagtgttctttggagtctggggaagtttggcctctaaaaatcaaactgccatggaaactgctatacccgaaattttggttcacagccttcattggattatctattgggacaaagtaaaaccarcgagcttgtattgctatctcatggctarggttccaaagctattgratcttcatttrtgtgtgtatatacgtgtctagatgtgtttatttgtatgtacacytattgttatacgttgtgtctaccataattggcytacaagtaaaagagcactcataaatcaagtaaataagtcagagcaattttcaagttcacatgactataagtataactttactaaacaagcagctttataaattattgaggaaataaaaatagaaatgccttcagaattgctagcatacgttttgatctaagttttagatttgtctctgctagatattcagaaggatcatggtttggcatagaaagttataaaactataaacccagccaaaacaaaatgatcttggtttgcctgcccttttttttttttgacaaatgatagtaatttaacattagctaaatcttctgagctgttggccaaaatatctatgtacttaactttgaggctcttacttaggtttgggtgagcacctgatgttcactggctattaaaaatgtggttaacaaggaaataactcactttaaataatagtgtctaatatctcagtttacagaagtaatctagataaactgtttaaaartraaaatttaagtacatgtraatgggataaatgttttaggtraactttttgtgtaaattaaaatcttaaarttatktttgatgctcattkaatatctgggtcatttccaattaagaaagggttgtratatggggaaatatgtttctaaatactgtggaattrttcttatctataaatgtccatatctartagytcaggatttcttgctttttaggrtttcactaaagttttaggttactaaggataaaattctagttaacacataattttgtatacaaaacgtaccagaaagggttrtgttattartgrgaaaaagaataattttrtctaattcagaagttatmtaaaagttagttcmarttacagayttsaaaaggttatttatgaaayaatgtactamgkaayyaktargtaggggagaaaratgtggaaaaagtttarataataaaatattctttaaaacctgataragaattggagacatttgrctaattaacattttcatagttaaagctgttagtcttgaytdataaaataagaagtattgtaaagaaacgcatcrgcagtttggcaattcttttttttaaatacagttaagcatgaagctggatttagtgtrgagccaaatttcayatacatamttgcattgcttcmcmctatgtttactgttttgcgtggatagtgctggcactggagtacttattggtcatgtgcctaragtgaatttcttgrttgyacaggatgtatrrtgatattggtrgacttgaggatayttaattgtgtatcaggaataaaatattcattatgtgagtttttttgggggrccctaggtaacactrtagtctccarggtarattgagtaggaamatttagggttggtktcctgtttayttgtytttgcttcyarttttcattcgtttgctgtttatttctcctctggctttscttgtgtgtgatcgtatatacataaaacyattgatttttttgwtwygttttttagttyctagtggaaggcttttatttggttctgtggatagttattttgtttcctatgctatatcattyctagcaagtcatcatttgttccrtttatctggaattcctargctacctttgttaggcccgcaggaattratggagcacacmarcttttctatcctattataaactaactttttggawtttaggcttcctgatactttaagggtgttgagtrtactytcwtaaatagaatttgagtcratatttctctttctctgcctaatttctccaaaatttgtaaactatktgtgactattcttaattcawkgcaatgtgwttgtttgcatacacagtcragcagggytgctagggcygctcagggagagagaacccagaaacctggcatgcwggcaaaagggtaagaatttcttaccaktcagwctctggcctctctctctctttctttctctctgtgcaaactggttaaatawawagtaaaagtcactgtttatctcctctgtaaagttttarattaatwkrwwwaagaattctgaggctggtcttaagctgtagtgaatctggtgtgctttatgtgtctttctgtattgttctgtcacaaaaaggggtacattaggataaaatgcgtgcctaggactccataggcttgctgttcaagatggcccagcaaactggacagtcatgtccttgggagcttgacctcgtaaccatgtggccatgctttctttctcttttcacaatggcagctgggtttagggttcaattcctggcttagggaatgagtcctttatcttctatctatgtatttatgtgtgttgtgtaatataaaagaactttaattaattggtcaattaataataataggagcttaaatcaaatattttgtcagaaaagtrraaagtttaatgccttttatttagttcaygtgrcttaagyaatctttgggaaataaagacagttttaaagattattggtaaaataaaaatrtcttcaaaaatgtaaaaatktggtctaaattatacagktcaratatyaggttygctaaaatgctttaaggtcataaactgcttgtttgacttttaaaaattattcaatttattttggagtattagattctaggtaagacctggagacatgtgaaattagtcatgtcacctagctatgcaaagaagtttataaagaaaagaaatcttacataagaaaggatcttatatggtaaattcttgtcctaaagtaaaataacaggttgtttaaaaggagagatgtttaggacaagtcagaaagtccaagcatattatagatggtctgtgtaaatcatgaaataatttatgaaagagaatttatgcaagaaatgttgtacagtttaaaggtgattaggcctcctaaatgcttcataamatgttactgtgactcgaatgaatawctgtwcaacttgcctgcttyacagctaggtaragcgcgtagggacasatggagtggccacrccccttccatgctctacctactgatgctggaaarggtcagaccttatctggacttctgggtgggtcctaggctccacccctagtacataattaaagaaccctaaacttatcaaggttwtcwtcaaaagtaaawgtcgycaagagytmgcattgtaacatstaatwgarcctactgaagaaacagttttacatsaaaggkatgtaaagcaagaaaagtgaaatagggtttggtgtttttggtaaaagattatawkmwwkmawrggaatgtgggtttttttgttgtgcctaaagggctaaaagattgttttaagttagaataaagctaaaggtttgaacaggttgtggaaggtttgcaaacaattaatcttgtaaaaaattatgtgtgtgaacatattgactaaatttaaagggttattttctggtttgtctgtaaattgaacattgaaataaaaacacaaacatggttttcttaaagcactgatctgctctttactaaaaatttatagagggttataaaagatttatgagattctcattgtatggtcaaactgattaagatcggaaagatttgtctataaggttttattaaaaattggggttgacattaatagtacactaatgcaagggtgaaatgtggctttctctcctgaacaagattttcatgtaatattaaaagacactgaaagatttttatttgccttttgaataaactaccaacaaaaaaagaagggaaagacaagagacagattgtttggaaagctaagtcttccctctttcaatgagtgaaggtttttgtcctttaaagaggtttttttggatcaatcattttggmtaaawgaawgwcttatggtaacctggagttctakwtcatamtatcaagtgttttaagcctctaacatatttgatcwgrmttcccaaaatcaaattgcakcttcaaaattgtcttytcwgtsctcgracttctgaggatgatgmgaagggcccacgtagaatcatccraaagagaggtgacaagaatcatttgacwcgtttagttacatgggaagtattsacaaaaactttratratytagtcttcttcaggttatwgtttagtgaatgactcatatatatattttccaaaattgtatgggatttctaaaattctaagatgtctgagtatatgtcatcaatcataattawggttattatgttaratgattgtaaaccacagaaataaccaaatttccttgtcaattgtgtttttaactgtaactatttaaagttatttccacagttaattgtttaatgctgatgcagtttctgaaaacgtcacaagcacacaaaatcctagaatatggtgtcttttaggaagttgattaaaggatggaaaggactctaaaaagcactcttgaatacaggtttctgagaactttagaatcatatcatttgaactgggtaagaattcctggaactttaatgaaaagactgactgggttataatacwgctaacctaggatagaagcaaaagattaattaaataccaagaaaatactttkccagatttytatkctaamtcggcwattactgaaattgtttagatatrcaatttgactgarttcbatggtctaadtchvagtaactatgataavccatcvgttahcagtgbtattcaccthctdtgdtgaaachactggtaddcaagabhatataabdctaatgtthattaagcatggattcatgtdddatgadgdtggtcaccttgavgdbbgchadtvctthaagagtttattattatgctacagtgtattttcaccargtaaagaaagaaarctttttatgkyytgaatcttctggaaacaycagagaaakactrtccttgycatccasrcyacwayaaaacttcrggrmyttgrrctttrggttcatrrtctcacaaytgagaagggtccctcyayrctcttsaarctgtrsacccattggaacccttaaggtwaaactaaccarggwaatagtthcaamtggacgaagagttcatctttgatgtaaacatctttttccaagatcacagattaagacttctactatcatgagactcttatccttgaatattktcttttgtttatgcctctatgaacaatagaaatgaaaaagggatctgttttgtgcacttatggggtatacttttatttgtgaaggattttgcagccagccttatacatggataatcttatactctgatagataaaagatgaagacccagtgtaggtgagaaactttaatgctacatacgttgcctcataatcagtcagaaacagaagattggttcactcccattaacccaaactcatgggttaaaaagaacadtcccaggaggccttcactcttctataagagaagggcatcatttattaggtctattttccatttkgwaggatttgdaataaaagavgtaatgatdaaaaatgtatccctcacaataggttctatagcagattctactgtaaagtctatagttacacaacagactttaaattatcttgtgaaagttatgctaaagaatagaattggccaaagagaaaagtatctatgcagctgctggcabtcatggcctatggdggaaaacathaggtrarkattatagagtttcagttgtagtggattgacaacaaaaadactgtttagttaagtgagtagactgcttatctagctcattctttgatctatttgattttaggtggtttggtttatggggaccctggataaggaacatacttcaaactcttggtattatcchchtgatagtcataataatagtctccctggtgcattgtattctctcaaaggttttacatgcttgcatgcagccatctctagaatgtcaaatggtctctcttcaagtggaatgacaaaagctgaatgaaatatgtgaccacaaggacactgtaacctatgaatggcatgctgagaccagaaacccaaaatgatggtaactgagagtggtactaaggctctaagttttgdtcatactcttacctaagtgagaacctgaccaaaaggggggaatttttaaaaacaaaattgtggtaggccattgttttggactgagctcatgcattagacctcatcagatcaaaccaaaaccaaaatggagttgcttgggctaagactttaaggcaatacatatggatcctagaavagaavaggttttgttttttctcctgtaaatctctataacaaacattcctgagagcataagtatchacctcctgaagttcccattaaatcttttaaccaaattcatttcctctctcctagagaccatcaagcttcagatgatcatgtgacaaaggttccagtcagttccaggtgaagacaccacccctggtcattaaggagctaccctgtctccattagahagagcagggtaagagttctgtgatccacaatgggtagggactacacchbgagccagcatgaagcagttacagaagaaagaccgthagtccctctgcctcccataaagatttatggggatcacatctcwtyggggggaa

SEQ ID NO: 185 - DNA, 1755 bp, Homo sapiens
  repeat_region (1)..(1755): mer52a
tgatggcagcggcggcccgtctggagtggccgctgccatgatgccggctgcagcgggggaggcgcggccggggctgcgcgctccatggagccagcgggagccgggaacaggcgggagccccgcccccttccgagttggggcgggagctccccgggtgcagctgcagccgcccaaacgcagacccaggcctccctgtgctcttgggggccgggagcaggcaggagccccaccctcccgggcacagctgcagccgcccagccgcggctscggacccaggcatcyctgcgctctcgggggcctgggaaggcccccctgcccccacaggcttggaagtgcctgctcccactgcagctggcctctccccgctcccggcgcccgctccgcaggctcagaagtgcctgctcccgctgcctggcctctccctgctccyggcgcccgctccgatttcggagcaaagttgyggccgagcccgggcgctgtcgcaacccggccgggtgtgtgcacgctcggggcagcgctgacacgccagccccctgccgcctcggccccctccggactttgggcgccgacgagcatgggagggaggccgagggggggctgagggcagctcggcgckggcctgcaggcgcccctcggcacgaacagcctgggtgccatgaacggcagcaggaggcagacaggctcctgggcagaaaggggcgggtccccggtgaaaccccaccttcaagccagggacggcctgaagcctgggggccgggctgccagttccgggtggagtccgcggmccggagtgagaacttrtggtgctttttctgggcccacccatggccgcccatggaccaatcagcacgcacttcctcccctctgargcccataaaaaccccggactcagccagactyagrcagaygwygggacgaccagctgcagagaggagctacccactccggggtctcctctctgctgagagctgcasagwcgwcgggatgacctgcctgcagagaggagctacccactccagggtctcctctctgctgagagctgaacactcgtcgggacgmcctgsctgcggaraggagctacccactgcgggtctcctgagagctgttctgtcgctcaataaagctcctcttcgccttgctcaccctccacttgtccgcgtacctcattcttcctggacgtgggacaagaactcgggacccaccgaatggcggggctgaaagagctgtaacacaaacagggctgaaacacgccccctgctcaccacgttgtgggcgacgagaaggagagaagagctgtggcccttcggggagcccagacctaggagctccccgagccagggctgtgacaccctctttggggctctgcggttcctggcgtctccaagcttctgggcgccaccgcgttccccggtgccmrcwgtggaagctgcttgcggtacgcctggtccagccgcagccttgcacggagccggcacctgtgccggcgcctggagctgcctgccccgccgcagccrgcgtgcctggctgtgcgcagtggccggaccccacgctcgcttgctcacacacccctcaccgctccgcgcctggctcgcccttggcaggcatgggatccaggccrgtagcgcgagcygagcgcagcctgccaggccgagtgggcggaatgagcccagcgggcccaagcaaaactcgggcaaaggcgccaccggccacagaggtttccggctggvraagcgacaccccaaggatcccgtgaca

SEQ ID NO: 186 - DNA, 1746 bp, Homo sapiens
  repeat_region (1)..(1746): mer52b
tgatggcagcggcggcccgtctggagtggccgctgccatcatgccggctgcagcagggaggcgcggccggggctgcacgctccatggagccagcgggagccggggacaagcgggagccccgccccttccgagttggggcgggagctccccgggtgcagctgcagccgcccaaaccgcagctgcagacccgggcctccctgtgctcttgggggccgggagcaggcaggagccccaccctcctgggtgcagctgcagccgcccaagccgcggctgcggacccaggcatcyctgcgctctkgggggsccaggaaggcccccctgcccccacaggcttggagccgcccgctcccactgcagctggcctctccccgctcccggggcccgctccgcaggctcagaagtgcctgctcccactgcctggcttctccctgctgccggcacccgctccgatctcggagcaaagttggggccgagcccgggcgctgtcgcagcccggccgggtgtgcacacgctcggggcagcgctgacacgccagccccctgccgcctcggccccctccagactttgggcgccgacgagcatgggagggaagccragggggggctgagggcagctcggcgctggcctgcaggcgccccttggcacsaacagcctgggcgccatgaatggcagcaggaggcagacaggytcctgggcagaaaggggcgggtccccggtgaggccccaccttcaggccagggagggcctgaaggctgggggccgggctgccagtcccgcggaccrgagtgggaacttgtggtgccttttctgggcccacccatggccgcccatggaccaatcggcacgcacttcctcccctctgaggcccataaaagccctgggctcagccagagcwgagcagacgacgggacgaccagctgcagagaggagctacccactccggggtctcctctctgctgagagctgcasagwcgwcgggatgacctgcctgcagagaggagctacccactccagggtctcctctctgctgagagctgaacactcgtcgggacgmcctgsctgcggaraggagctacccactgcgggtctcctctgagctgttctatcgctcaataaagctcctcttcatcttgctcaccctccacttgtctgtgtacctcattcttcctggacgcaggacaagaactcgggacccaccgaatggcggggctaaaagagctgtaacacaaacagggctgaaacatgccccttgctcgccacgttgtgggcaaagagaaggagagaagagctgtggcccttcggggagcccagacctgggagctccccgagccagggctgtgactccctctttggggccctgcggttcctggcatctccaagcttccgggcgccaccgcgttccccrgtgccagctgtggaagctgcttgcggtgcgcctggtccagccgcagccttgcagagagccggcacctgtgccggcgcctggagctgcccgccccgcwgcagccrgcgcacctgactgtgcacagtggccggaccccacgctcgctcacacacccctcaccgctccgcgcctgactcgcccttggcaggcatgggatccaggccggtagcgtgagcygagcgcagcctgccaggccgagtgggcggaacgagcccagcgggcccaagcaaaactcgggcaaaggcgccaccggccacagaggtttccggccagaaaagcgacaccccaaggatcccatgaca

SEQ ID NO: 187 - DNA, 1278 bp, Homo sapiens
  repeat_region (1)..(1278): mer52c
tgatggcagtggctgctgccatcacgctggctgcagcagggaggcgcggctggggctgcacactccatggagccggtgggagccccgccccttctgagttgggacgggagctccccgtgccactgcagccgcctaaaccgcagctgcagacccaggcctcctgctccacggagcaggcaggagccccgccctcctgggcggggctacagccacccaaactgcggctgtggatccgagcctccctgtgctcttgggggagccgggagcaggcaggatctgccytcccgggtgcagctgcagctgccscacccgcggctgcagacctgggcctcycactccaggragcaggcaggagccagggacaagcgggagccccgccccttccgagttggcagggcgggagctcccgggtgcagctgcggcctaccctcccaggcgcaggacctgggcgtctctgcagcctgcacccttggggggcccaggaaggacccwccccatccctgcaggctcaggggtgtctgctcccactgcctggcctctctctgctcctggcgcctgctctgatctcggagcggggttggggccaagcccyggggccatgaatggcagcgggaggcagacagattcctgggcggaagggggcgggtccccagtaaggccccaccttcaggccagggagggcctgaaggctgggggccgggctgccagtcccgcagaccagagtggggactcgtggtgcctcttccgggcccacccatggccgcccatggaccaatcggcacacacttcctcccctctgaggtccataaaagccctgggctcagccagagcagggcagaggatggccagaggacaaagrgggcagagagacaatgggacwggatgaccagctgcagagaggagctaccctctctgctgatagctggagaygatggracgaccagctgcagagatgaccagctgcagagaggagctaccctctctgctgagagcttcagagacctgcagagatgacttgcctgcagagaggagccaccctctccagggcctcctctctgctgagagctgaacactcgatgggacgacctgcctacagagaggagctacccactcctctgagctgttctaacactaaataaagctcttcttcgtcttcttcacccttcacttgtctgcgtacctcattcttcctggacgcaggacaagaactcgggcaaaggcgccgcggccacagaggtttcccgccagaaaaatcgacaccccaragatcccgtaaca

SEQ ID NO: 188 - DNA, 189 bp, Homo sapiens
  repeat_region (1)..(189): mer53
gggttgccagatttagcaaataaaatacaggatgcccagttaaatttgaatttcagataaacaacaaataattttttagtataagtatgtcccatgcaatatttgggacatacttataactaaaaaattattcattgtttatctgaaattcaaatttaactgggcatcctgtattttatctggcaaccc

SEQ ID NO: 189 - DNA, 902 bp, Homo sapiens
  repeat_region (1)..(902): mer54
tgtagtgaattcttataattttatgttgcctcggcatccattttgaatataagtttaactttctcataccagaagcagggctyagtcacccttgacacggtttccagttctccacctcctcccagttcctcaatgtggtcgacccagatatctgccttatacmaccgcctcctggkgaccacctccctatggaacagctggatacaacctacttgacttgccccactgacccccacaccccacatggactgtgcaggtatgccacagtgaccacctctcagtcacagcgtgaccccacggaactcgtgcctgcttgctctaaacccaccaattagaactccccgcgggaaacctgcttgggtaacgccctggaccccaataaaggctttggtcccacaggtctctctctctctctctcgttctccccacccgttggttgagcatgcgtgtcccggacagcttcccccttcccattggccctgcgaggcatgctgccctcttctctctgggatctgtaagtaataaactgcttctgttatttcatgtgttttgttgtgctgcctcctctgtgtctcacctgaccgacacacccaaacctaactctcttcctggtcagggctctcctagagagtggctatcttggcaggaataaactggacacaggtcagacaagagccacaagggcgtctgccagtgtaaacaagtttcctgtgagagggacacctggtcacgggtcggacacctaggcattaggccgtccgccaggataaagaagtatcccgtgaaagatacactgtaaacacccacaaccamcttccctggagccccatcagggcagggctagagtttatagccactctccagagagagacctcaagaccaaattagaggaaaatacaaca

SEQ ID NO: 190 - DNA, 790 bp, Homo sapiens
  repeat_region (1)..(790): mer54b
  misc_feature (4)..(4): n is a, c, g or t
  misc_feature (241)..(241): n is a, c, g or t
  misc_feature (354)..(354): n is a, c, g or t
  misc_feature (501)..(501): n is a, c, g or t
tgtngtaaatwcttataattttatgttgcctcagcatccattttgaatacaagtttgactttctcataccagaagcagggctcagtcacccttgacacggcttttagttctacaccacacccaaatggctcaagccggtggccagagataaaaacttggaggcatctctcccgcctggcagactgggctccccactttcccgccgcttcctttaaaaagaccattcaggcatttgcccgcnaacttaaagtgaccacaccctgttcccttatatatgctgctagctgtcatgctctctctgcctgactcttcattcctgcctcgcgtgacccggggacggaggactgccctccngactcattgcaccctccctgtccaggacctgtaagtaaaaatctttgaacttgtttcctattgtggtggtgtattgaatttgcgccttccatctgaagaaccaggggctgccccaggctgggttttccccgggatgccagggagaanacaaggtcaggctcccagtgccagagcgatggtcaggcaggcataaactggacacgggtcagacaagagccacaagggcatctgccagtataaacaagtttcccgtgtgagggaccccctggtcgcaggtcggacaactaggcattaggccgtccgccaggtaaaagaagtatcccgtgaaaggcacactgtaaacacccacgtccagctccccttcattttccattagggcagggttgctagctgctctggtactggaaccccaatttagctgggggctctcaaaaca

SEQ ID NO: 191 - DNA, 398 bp, Homo sapiens
  repeat_region (1)..(398): mer57a
tgttaaattaagtttagcctaaagctgcctccttacatattttaagttcggcctaaaggtttctctgtacatagtgaactataacctaactggaggtgtaaacagaccgtagcctactcttgtgccaatcactgagtttcggccaatcacaggcagccaactgttcaaaccatgttcaaataaggcaaatgccgagctgtaaccaatccagctgtttctgtacctcacttccattttctgtacgtcactttcctttttctgtccataaatcttctaccacatggctgcactggagtctctgaacctactctggttctgggggctgcccgattcgcgaatcgttctttgctcaattaaactcttttaaatttaatttggctgaagtttttcttttaaca

SEQ ID NO: 192 - DNA, 434 bp, Homo sapiens
  repeat_region (1)..(434): mer57b
  misc_feature (179)..(179): n is a, c, g or t
tgttaaagcaagctaaatatagcctgagaaggactccgtacttctatatttgagtccttgtggatgaactgtaacctagcttaataggcagacaaggttgaaaacctaacttaggagtatgcgcctgtaacaatagctgagtcttggccaatcccagcggccatacttcaaccactcanagactgctaagtgttcaaaccgtgttcaaataaggcaaacgccgacctgtaaccaatccagctgtttctgtacctcacttccgatttctgtacttcattttcctttttttttatctataaatttgttccgaccacgaggcatccctggagtctctctgaatctgctgtgattctgggggctgcccgattcgcgaatcgttcattgctcaattaaactcctttaaatttaattcggctgaagtttttcttttaaca

SEQ ID NO: 193 - DNA, 7488 bp, Homo sapiens
  repeat_region (1)..(7488): mer57i
  misc_feature (155)..(155): n is a, c, g or t
  misc_feature (252)..(252): n is a, c, g or t
  misc_feature (259)..(259): n is a, c, g or t
  misc_feature (296)..(296): n is a, c, g or t
  misc_feature (564)..(564): n is a, c, g or t
  misc_feature (1021)..(1021): n is a, c, g or t
  misc_feature (1093)..(1093): n is a, c, g or t
  misc_feature (1119)..(1119): n is a, c, g or t
  misc_feature (1136)..(1136): n is a, c, g or t
  misc_feature (1192)..(1192): n is a, c, g or t
  misc_feature (1435)..(1435): n is a, c, g or t
  misc_feature (1608)..(1608): n is a, c, g or t
  misc_feature (2404)..(2404): n is a, c, g or t
  misc_feature (2444)..(2444): n is a, c, g or t
  misc_feature (2448)..(2448): n is a, c, g or t
  misc_feature (2554)..(2554): n is a, c, g or t
  misc_feature (3077)..(3077): n is a, c, g or t
  misc_feature (3250)..(3251): n is a, c, g or t
  misc_feature (3291)..(3291): n is a, c, g or t
  misc_feature (3304)..(3304): n is a, c, g or t
  misc_feature (4750)..(4750): n is a, c, g or t
  misc_feature (5567)..(5567): n is a, c, g or t
  misc_feature (5601)..(5601): n is a, c, g or t
gatggcgtcagaagcgggatccgaagtagagcttctaacgacccccgggagcactgagcgaccaaagcgaggtasctgcwggacmcacttgtgtccattgatctctcggagcagctggggatcatggtaagttctctctcggatttcggagctcnacggatttgtgtttcgagctctccgagtttctttgagcaaatttctgatccaaactgggtttggaagtcgtgacagaaactggactgggtccaggantggattngatccggtaattaaccggcttggatccagttagaggnctcttacatctgactgggtcagaaagaaactggtagtaaatggtaatattgcagggggtgtaaaatttggcttttgaaaattcgcggggatttttgtgttctacccctttgtttcatttttcttgcacgcttaggtaggaaaaaatcattggctaagttgatcaagggaatctgagagtaaagccaatatttgaggtaaaaatgggatccttaatttctgaagaactgagttccttctggcttatacgcgcacaagtgttaggccccnaaagcggcgaagtcttacagaaatggcgaaatcttactaaagataacttasagtggaacgttccgaatgaacgacactgcactgaagtgcatttgaaaatgagggctcccaaattagtctcatctagggatgcctattgatatgcagaagcttctaaaaakatttcagtatttttatttaaagactttatgaaaggcaaataaaaagcttaagcgactaattgattwwaaaattaaatctgctaaccttttagcttagttactatcctcatccaaaggaaacagactgcagcaccaattggctgactttgggtaagtagtggggtacattttacctgagtaaaggatgggattgggttagaggccctcccctcagtaaagtccctcttggttaaaaatggatttggcactatgggatgttaaccgctattctctttggattaatctgccttgtactntttgctgacggctgtgagtgacaggattaggcatgtacaggaccatgggacatggggaactttttyctcctnaaaaggggaaacttgagagctgatgngactgctggaaaagatnccttcgtgaccgacaagcggccgcctgaacttttgattcagtgtcgctgcgagtgngtctttctctggcctccctgagctcctcgccttccccaccccgccacaggcaatgcttttctcccttcctctcctttccctttcctatcttttctgttactcagggcagccatcttgcccagagaccacatgttaaatctcctggtgggtggttggattaaagatgacagggcccaaccgggggcaagtttgagccttgccagttcgatattgggcgctgagcggggtggctaatgtctatgntttgtcacatgtattttgctctggccggaatggaaaatgttaatttggttaccccatgcarcccgttgggcggcatcttgcaaaattgagaggcttttgcctgtggttccatgaaacggaaaaagatgattttcttttgtgatgtggcttggcccccagagctatggcgcggngagctgggtcatcaaagctgctcagggaaggggaacccagaagcctggcacgctggcaaaagggtaagaatttcttaccagtcaggcttctggcctctctctctctgtgcaaactggytgaatgaatggtaaaaatcactgtttatctcctctgcaaagttttgattaatgggaaaaaggattcgcgaggctagtcttaagctgtagcgaatctggtgtgctttgtgcgtctttctgtgtcgttctgtcataaagaggggtaccttaggatagaacacgggcttaaaaccccataagctcgctgctcaagacggcccagcaagctggtcagtaacaaactttgctgcaggtccctgaaacaaacaaaaaaactggatgaggtctccatcttgttttatgtctttgggagcttgaccttgtaaccgtgtggcggtactttctcttggtctccgccwtccagggaacaggaattttggggttcatgtcatagttagctctaaaaattatcttgagtagttaaaagcctttgcaagctcaaaattgactgctctagactccttccgggaagggcaacggagactgcccagtgctgtagctcagcagctaaggcttcgccattttacaatggtggcccgggttcaatcctggcttagggaatgagtactttctggttgatatctgtgtgacctttaccatttgttgattctcttcccctccacgaacaacttctagctttccttcttgaattttcctttctctgagctacccttgaagattctagattttgtagaaactncttaccacctctttgaaaatatctcgtacactcgtggttnagtnataaccttagttgaggcttgttggtttcacctgggaggttacttttggtaaagttcaaargccagaaatattggccgtttggcccggctaaagtcgggtaataagnaatttaaaaggacttttwcttaaagagcgctgtggttaaaagtcagcttaattaaaagtggatatccaagctatacgtatatttaaaaggcctttatgtttttttttctcttcttggmtcttatttttctggaaaaggtttttttcttttcagtcaactgaattrcttttctccattttgtcttctcgccactcttgatgcacgcatgagaggacctaagataacttctaatagcctgggactcctcgggaaaaacagaggaggcgccacagaccccgttttgggaaaaaactctgttttcctcatgaaaccccaggaattgraagcggatagatccctctcaaaatctaaggctctgttctgttttgcattgtgttatctgacggttttgagttttgggggtatcagaaattacttcgcattatgagagagctttggtgtgtaataactaggtrggaaatacacwtttagggatggctaatggcagttatgggggatactcggctctttgcacatttggatnagagaagcatgctcttggccacctggaaggtatgaaaatgtccccaccccccactgagagatgagactcccatgggggatgggctgattacaaaatgggctaattggctttgggttgccttgcaatgaaatgcatggtaaaagcattgcaccgtcttctcccatagcatttcnntctttttggggatccaggatccaatataaaaatgggaccnttaattttggggntctgcttgccttccagctgtgcctgcttattaggccctagaaactgcatgctttcctggccctgttcctcgaaggactccgccctgaagccagtaatccaattaagaaacttaaaaactggcaaatgaaaaatcttacaactactggatcttcttcaagagctctgattaattggcttaaagaaaaataagcgcttaaatcaaatattttgwmagaaaaataaaaactstaatgccttttagytcacgtgactttagtaatctttgggaaataaaaacagttttwaaagattaytggtaaaataaagacatttggtctaaattaggcaggtcagatattaggtttgctaaatgctttaaggtcataaactgcttctttgacttttgaaaattgttcaacttacctgctttggagccattagattctagataaggcctggggacatgtggagttagccatgcccctagctatgctggaaagagtcggaccttatctgcacttctgtctgttgtcctaggctccaaacctagtacataattaaaatcacttaccaggtttttcaccaaaaataaaaattgctaagagttaacattgtaacatgtaattgagactactgaaaaaaacagttttacatgcaaggtgtgtgaggaaagtgaaatgtgcttttggtaaaagattataagaaggcatgggaatgtacatttttgcctagtttagagggttaaaggattgttttaarttagataggataaagctgaargtttgagcaagttgtggaaggtttgtaaaaattaatcttgtaaaagaaattctgcgtgtgaacatattggctaaatttaaaggggtattattcagttttttccgtaaattgaacattgraataaaagcacaacagggttttcttagagcactgatctgctctttaacaaaaatttgtaaagggttataaaaggtttatgagaatctcaccttatggtcaaactgattaagattggatagatttgtctataaggttttattaaaaattggggttgacattaatagtatactaatgcaagggtgaaatttggctttctctcttgaacgagattttcatgtaatattaaaggataatgaaagatttttgtttgccttttgaataaactacwggaaaagaagggaaagacaagagacagatcgtttggaaagctaagtctttcctctatcaatgagtaaaggtttttgcctttttaaaatttktgagtcatcattttggcgaaatgaatgacttatggtgacctggaattctatttcataatatcaagtgttttaaacctttaacatatttgacaggcttctcaaaatcaaatttcagcttcaaaattaagtcttttttgacctctaactttgggatgctacagagggctcctgaagcatccaaaagagagataaacaggattatttganatgttaagttacatgggaagcatcgtcaaaataaaaataatgtttaaccttcttcaggttatattttagtgaataatattaatatatgttccaaaattttatgggatttctaaaattctgatatgtctgagtatatgctatcaatcataattatggttattatgttaakttattgtagaccacagaaataaccaaatttccttgtcaattttgtctttaactwcgactatttaaagtcatttccacagktaattgcttaatgctgatgcagtttctgaaaatttcacaagcacgcaaaatcctagaatatggtgtcttttaggaggttcgtgaaaggatggaaaggaccccgaaaagcgctcttgaatacaggtttctaataactttagaatcgcatcatttggactgggtaagaattcctggaactttaatgaaaagactgactggtttataaaactgctaacccaagtagaacaaaaattaattgaataccaagaagatactttgccagattatcatgctaaatcagccaatactgaaattgtttagatatacaatttgaatgaactccatggtctaagtcaaatgacctatgataacccatcagttatcagtgctatgcacctaaatcggagaaacaactggtattcaagaggacataagtccaatgttaagcatggactcatggagaaccaggacggctgccttgtccttcctgagtccttaaagcttttgttattaaaagttctgcattccatgactcatcatggaaaagataaaatgatccaaattaaatatatattggtgtggtgacttntacattgctaaaatagtttatgaccaatgtttgntttgtcaaacccatattcctgggaagacaatcaaagcttcaggtacattcggctacctgatgggccatttaaacatttatagagggatttcattcaattgtcattttcaatgcatgttttctggttgtataaaagctttcccatgcaagagggstgatgttataacagtagattattacgccacagtgtattttcaccaggtaaagaaagctttttatgattcactgactgaggacaatcagccccttcacaatctagaacccaaagactggatcttctgagaacatcagagaaagactgcccttgccatccacactgcagcaaaacttcgggactttgaaccttgggttcataatctcacaactgagaagggtccctccacactcttggaactgtacacccgttggaacccttaaggtaaagctaaccagggaagtttctccccagaagaagatgscatccttgatgtgaacagcttttcccaagatcacggatcaagacttctctactatcatgagactcttatctttaaatatttttcccttgcttatgcctctatgaacaatagaagtgaaaagggggtctgttgtgtgcacttatgtggtatacttttattcgtgaaggattttgcagccagccttatacgtggataaccttataccttgatagatgaaagatgaaggcccaatgtaggtgagaaactttaatggtacatacattgcctcgtaatcagtcagaaacagaacgttggttcactcctcttaacccacatcatgggttaaagagaacgttgccaggaggccttcactcttctagaagggcatcattcgttaggtcmtttttccgtggtttggagtaaaagaggcaatgattagaaatgtatccctcatgataggctctatagcagattctactgtaaaggctatggttacacaacagactttaaattctcttgtgaaagttatgctaaataatagaattgctctagattacttactggctaaacagagaagtatctgtgcagctgctggcgcttgtggcctatggagaaatacawcacattaggtattatasagattcagttgtaggggattaacgaagagaccgcttagttaagcgagtagactctttatctagctcattctttgatctatttgattttaggtggtttggtttatggggaccctgggtaaggagcatactccaaactcttggtattatcctcctaatagtcataatagtagtctccctggtgcgctgtattctctcgaaggttttaaatgtttgcatgcagccatctctagaatgtcaaatggtctctcttcaactggaatgacaagagctgaaggaaacgtgtgaccatgagggcaccataacctatgaatgacatgctgagaccagaaacccaaaatgatggtaactgagagtggcgctaaggccctaagttttggtcacactctcacctaagtgagaacctgaccaaaaagggggaattttttaaaacaaaattatgggaggccattgttttggactgagctcatgcactaggccccaacagaccaraccaaaccaaaatggagtcgctcgtgctaaatgtgacataatcaaactaagactttaaggaaacacatagatcctagaacagaccaggttttgtttttctcctgtaaacagaatgttccagcataaggaggtaccctctactctaacccttacaaaaaaawaatgacctgaagtccttgttcccaccttgcaaaacccactgttctactgtttcccagtgggtttcaagaccaaataagtacatttatgatggtgatagtgacatcaatgactaaagttttggtcaatctctcaaaattgagaaaatgaccaaaaggggggaat

SEQ ID NO: 194 - DNA, 189 bp, Homo sapiens
  repeat_region (1)..(189): mer5a
cagtggttctcaaagtgtggtccccggaccagcagcatcagcatcacctgggaacttgttagaaatgcagattctcgggccccaccccagacctactgaatcagaaactctgggrgtggggcccagcaatctgtgttttaacaagcyctccaggtgattctgatgcatgctcaagtttgagaaccactg

SEQ ID NO: 195 - DNA, 178 bp, Homo sapiens
  repeat_region (1)..(178): mer5b
  misc_feature (58)..(58): n is a, c, g or t
cagtggttctcaaccytggctgcayattagaatcacctggggagyttttaaaaatccngatgcccgggccacaccccagaccaattaaatcagaatctctggrggtgggacccaggcatcagtattttttaaarctcyycaggtgattccaatgtgcagccaaggttgagaaccactg

SEQ ID NO: 196 - DNA, 866 bp, Homo sapiens
  repeat_region (1)..(866): mer6
  misc_feature (225)..(226): n is a, c, g or t
  misc_feature (273)..(273): n is a, c, g or t
  misc_feature (345)..(345): n is a, c, g or t
  misc_feature (409)..(409): n is a, c, g or t
cagcaggtcctcgaataacgccgtttcattcaacgtcgtttcgttataacgytgatgagraaaaaaatcgattcccggccggggccactgtctgtgtggagtttgcacgttctccccatgtctgcgtgggttttctccaggtactccggtttcctyccacatcccaaagatgtgcacgttaggttcaytggcgtgtctacatggtcccagtctgagtgagtgtgnntgtgtgtgtgagtgtgccctgcgatgggatggcgtcctgtccagggntggytcccgccttgcgccctgagctgccgggataggctctggccacccgtgaccctgaamtggaataagtgnrttgraaaatgaatraatgaatgartacgaattattataaaataaaaatttgtaaagtctatgntaatcttacacatacatgacaatacatgaaatggtaagaaagtgatcagtgagcctgccatatatgttattgcttgtttctgaactgagtggtgggaggaggtgttcctaacaatgttcactttgcagacatttatttctttatttaatccattatcactatgaccactgtcattcagtkattcwccaaaaattgggtaaataattatcwtryttgtttttattaatctttcttaaatgtatgtatagctcacatttatttcagtgtttaatattagaagtgttttgggtctttatttagaagtttggtgatgtttttgtgaccagaaatatgccataggaacttaactcttgtttatatcaattagcctrtggtaaaattggtttcgttatacgtcgtttcacttaaagtcgcagtttccaagaacctatcaacgacgttaagtgaggacttactg

SEQ ID NO: 197 - DNA, 837 bp, Homo sapiens
  repeat_region (1)..(837): mer60
  misc_feature (338)..(338): n is a, c, g or t
tgcagrttgctagtgccagagggagcaaagaattgtgattgtggattttaattgctggcagctccctgaaggactcacaagtctttttttctcggctgaagtggttcaaaaacatttaaaggcacatttgctggagcaagggacaacatgrgrcaagcaayagatagaccaaaaagcctaagaaggaagagmtgagaaataagatgcttggggaaawaagggctttgaaaagtccacatattcctgggaatctagaaggccatgcacatgtccagggctggacacatgctcagaaaagacctaagaaggccctaagctttcacctctggctgaccttnagactctgtacaagcaggaagtgaaggctaaggcagagttgtaaactgccttggctgagtgttgaaggaatgccycaacacacagmcaatctgcaaagactaggagactttttttttgtgtttggtddtkttgttgttrttccaggtatttaaggaaayctctgtcaawyactagctgaccactaagctaaycgarcagagacttcagtggccacacatgacaaagaatacagactttacaaaattagtttagaaaagtcactaaacaaacaayacaacagcamayaayaagcaacaacaacaaaccctggaaaggggagagaatctgatttccagagttgccacattatawtatttaaaatgtccagttttttttttcaacarcaacaaaaattatgaggcatacaaagaaacaaagaaaagtatggcccatacacaggaaaaagaaattaatagaaactatccctgaggaagcccagacattgracttactagacaa

SEQ ID NO: 198 - DNA, 354 bp, Homo sapiens
  repeat_region (1)..(354): mer61
tggtagtgagacagccagatgggaaggggtccccggagaaactccaaccggcctgcgcactgggaggartgcgcactggggtggagccacagaagttcgcgccatttgcagcggggaggagcctggcccctcctcttcctgggtggaacctgggattcgaactgcgaggcgggaagtscactagcaggaarcacagtctctcrctttgctgagrgtccctgtttccccttttcttccttttcacysaataaaaycycgycttactcacccttcaaattgtctgcaagcctaawttttcgtggccgtgtgacaaggaccccgtctttagctgaactaaggaaaagtcctgcaaca

SEQ ID NO: 199 - DNA, 425 bp, Homo sapiens
  repeat_region (1)..(425): mer61b
  misc_feature (195)..(195): n is a, c, g or t
tgatagagacaggaggcagccaagggtcccccggtgaaaccccaccttcaagcctaaaacagcctgaaggctgaaaaaccagactgctggtcccggatgaagcccaccctttcctgactgattctctctgaataatgcccacctgcgcactgggaggacggggtggagccacgggaagttcgtgccttgtgcagnggggaggagcctggcctcttctgttcctgtgtggtggcctggggttcaatctgtgaggtgggagcctgttggcaggactccctctcgctttgctgagagttgtttttcctttttccttttcgcccaataaattctgctcctcacccttcaatgtgtccgcgwgcctaatctttcctggtcgtgtgacaagaacccagttttagctgaactaaggagaaagttctgcaaca

SEQ ID NO: 200 - DNA, 434 bp, Homo sapiens
  repeat_region (1)..(434): mer61c
tgatagatgcaggaggcagataagggagggtccccggagaatctccgacccgccccacaagtgtttacatcagatgcttttgtgcagatgagggaacctgcccagggccttgtctgggcatgcccacaacgaactggggggcccacctgcgcactgggagaatggggtggagccaccgggaagttcgcgccttgtgcagcggggaggagcctggcctcttcagttcctgtgtggtggcctggtgttcaatctgtgaggtgggagcctgttggcaggactccctctcgctttgctgagagttgtttttcctttttccttttcacccaataaattctgctctcctcacccttcaatgtgtctgcgtgcctaatttttcctggtcgtgkgacaagaacccgggttttagctgaactaaggagcaaaatyctgcawca

SEQ ID NO: 201 - DNA, 5217 bp, Homo sapiens
  repeat_region (1)..(5217): mer61i
  misc_feature (192)..(192): n is a, c, g or t
  misc_feature (334)..(334): n is a, c, g or t
  misc_feature (463)..(463): n is a, c, g or t
  misc_feature (1627)..(1627): n is a, c, g or t
  misc_feature (1901)..(1901): n is a, c, g or t
  misc_feature (2623)..(2623): n is a, c, g or t
  misc_feature (4829)..(4830): n is a, c, g or t
  misc_feature (4833)..(4834): n is a, c, g or t
  misc_feature (4839)..(4839): n is a, c, g or t
tttttggcacccaacgtgggggcttgagaaagggtgagtgagatgcaaaccaaaaaatctttttcccttttgcttctaagccttttcatccttggacttctgagggtaggggaaaccatgcccccacccccatcactcccaggggtcggaggcctttccatggccttttccttcctttttcgggatggaccngtgagcagcggctcccccctccctcccctccctgctggggctgggacgcatggcccaagggtccccagkggcatggctggcgttctctgccacrtrtccacagagtcttcccctcccctggccaaggagttcagctccatcngacagcaattaagcttctctccctggtggaggaaccatttgcataagaataagaggttcttccccaggcatttttaaactgttttttttcttcyytttctccaccctgtcagcagttaacttttaagtnagkttttttcttttagaagatgttttactaggccaggaatcataaggatcactgtttatattctctgtaaagttttaattgtgaaaaaggatttgtgaggctggtcttaagctgtagccaatctggtgtgctttgcatgtctgtatggttcgtagcaaactttgctgcaggcctccatcttgttttacgtccttgggggcgtggcctgtaaccacgtggcaaggcttttcgtttagcctctgccattttayagtggtggcccgggttcaatcctggcttagggaatgagtcctttctggtttgatatctgcgtgacttttgccatttgttgattctcttcccctycacgaaccgccttgaattttcctttctctgagttryytttaaagsttytarattttgtaagaactgcttamcccctctgaaaatacctcatacaatggcagttaaatcataaycttaattgrkgcttgttggtttcacctgtgaagttacctttagtaaagtttgaaagccagaaatattggccgcttggcgcggctaaagtcaggtaataagggagtttaaaaggattttcttaaagagcgctcagcttaattaaaagtggatacccaagttataggtatatttaaaaggcctttatgtttttcttttcttggatcttgttttgctggaaaaaggtttttttctcagtcgactgaattmtttttctccattttgccttgccactcttaatgcacgcatgagaggggagagacctctgttttcctcatggaaccccaggaattaaaagcggatagatccctctcaaaatctgtttttgctscawytatrcctrtttattaggccytagaarctrcatgttttcctagccctgtctcttaaagggccccacccagargccaataatccaattaggagattggcaaacgaaaratcttatggctactgggttttcttctgcctgtctgtgtagttatgtatgtgttgtgtgtgtgatgtctataaaaagagctctaattaattggcctaaagaaagacaagcacttggatcaaatattttttaaagggaagataaaagctgtggtacctttcagttcatgtgactttaatctttgagaaataaaaacagccttaaagattattggtaaaaagcagatgtyntcaaaatgtaaataggtgaactaaattatgcaggtcagatgcaaggtttgctaaatgttttaaggttataaactgctttttgggttttgagaactatttgacttgccggcttcacaactggtaaggcctggggacatatggaactaaccacacccttaattatgctggaaggagtcaaaccttggctgcacctagcacacaattaaaacaacttaccaggttttacattaaagttaaaaattgctaggagttaccattataacatgtaattganactactggaaatagatttacatgcaaggtatgtaagaacagtaaaatgtgtttttagtaaaaggttattaagaaggcatggaaatgtaaattyttgcctagggtaaaggattgttttaaattagataagaaaaagctgaaggttcaaacaagtggtggaagaattgtggaaattaatcttgcaraagttctctgtgtgaacatattgactaaattcaaaagggtattatatggtttttctgtaaattgarcattgaaataaaagcacaacaaggtattcttaagrcactaatctgctctttrgcaaaatttgtaaagggttataaaaggtttttgcttytttaaaatttctgagtcatcattttggcaaaataaataayttatggtaatctggaattctatttcataatatcaagtgttttaaacatatttaacagscttcccaaaatcaaacttcagtttcaaaattgtctttcctgatgcctggctttttggatgcttcagagggcccctggagtatccagaaaagagaggtaaacaggattatttgacatgtttaggtacatgggattgccaaaatgatgttcaatcttctttaggttatattttggtraataatactaatatatgttccaaaattgtatgggatttctaaaattctaatgtctgagtatatgctatcaatcataattaaggttgttatgttaagttattgtaaaccanggagataaccaaacttctttgtcaattgtgtttctaactgtaactaccctggacattttgttattcacagacaattgttgtcttgttttaatccttttcaaagatggtttataataagctatagaactttgacaggtgctctcaaatacaggtttctgataactttggagattgtaacattggaataaaggaaaatgtacaggactcatgaagagctaaaatgttcacgaatatcaagcaaaacaagagttaactaaatggactgaactcagaaagctgaagcaatctttttgacttttgcttggaatattgctgatccttgttttgtttttcagagtcaaggaaacttattttgaactatttatggcctttaataattgagtaaggtatactcctgtgaacaaaatttggagcatgtttgtttctctctgcctggttcctctagaatttggaaactatctgtgagtattcttaacttatggcaatatagttgtttgcatcaagtgcaataagaatccatttttcttttgcaacaggacrcaattggagaaastggttattttaccaaggctttgactggaagggtatgcttccctttaaggagtcaakcttgacttgcagagccaataaaagccccktgggaaaactggcctcatacccttgtctacacagtccctgtacagggttcctgacctgtggtcagtaaagaatgtcactttctaacaggyccaggagctccaagtttatcttgggaccttaagaggagaggatcacccaactcacaggtatttgaggatacaaacccatggctgggctcagctttaaaaggtcttatctgagattccttgtggaacagagttccatcaaagccaatctaaaaggcctatgtagaaatarttattcttgctgcactttatgcaaataatcaggccaagtataagactaaagtctattttgcaaacaactcagtcctatcatgattttttttaacaaaaatgaggactggagagagagaaattatgtttcaaaacttatcatacatttgtcattaaattctaaactcattagttgtttttaagtttttgcctacattttagactaaccctgcttgttcctgtgaaccaaccagcaatctccggctgcagctcagaaagaacaaaagggatgggtaatgtagaaatctggatcaatattctagttctgagcaattatcctgcaaatcctgccaggtgatgggaataaataggatgcccatcacttggaggtttcctttttgggaaagtaagaccaagggagctaaccaaagccaagcaccatgcacccaaatcttagcaagcataactatagccaccagttatctgggtrtgtcacaagacatccttttctctcccttgttggaggaggactcaattccacagtttcaccttagcatttagcttatgataaggagtccatgcaacccccccgagacacatttttgtcccaaactcaattccaagcttygggtcaaagccctaggaaggaaaactggatctgagggatccagaggcagatgataacagaagttaaaaggcacagtgcaggtgagcatggctgattcctgccgattaagccaagcttcccgtttcatggataaaggtcatgttagtatccatggcataaatgaggtctagggaattcaaggctactgacagcaggggagatagggcatacgtgggtagagcggataattcccatcccctaggcccccctgcttcatgggtgcaagccgctttgacacccatggtggcacctgccaaggtcactgggactcggggatgcaaggacggaagagggaaagaggacgctcttccttctctccctcacgtaccctgggtatctgctaggaagagaagggaaccagggatgcctgctcccctctttctagatgggtagccattcatcttcagtctgtacccctttcgaatgcatcctgaacccctgggactcctttgaaaaaatgccttcttttttcctttttcctcctctgttctctcttcactgataggtaattgtgtctccatactatgggacactcccctcagatgcatcctccaaactggaaagagttaatttcccaaaccttaaactggttggcttaggattgggctcaggggaagggaacccagaagcccaacatgccggcaaaaggtaaagtttttttttnnttnntttgntttttttttgtttttttctttttgtttttttaccagtcaggcttttggcctccctctccctgtgcaaactggtaaaaggccttgggatttttgagctgtccttacccctccccttgtttcattttgatacatgttttctaataacctggtttgtctgttcttgccttcaggccatcaaactccaaatggtcatgcaaccrgagcctctgacaatggccccttctgctrggaacccttagataggcctctgagggagatctgactgccgttttcccaaaacagtgccccctgtcagcaggaagcagttaagattggtcttcgtccttatccttatccttattctaatggcagttagatgtacttctttagaggggggaa

SEQ ID NO: 202 - DNA, 211 bp, Homo sapiens
  repeat_region (1)..(211): mer63a
  misc_feature (47)..(47): n is a, c, g or t
ccagtggtgtgctggtaaatgtttaacaactggctctctgggggarngaaaaaaccctgatttgtagcgtttgccgatttccgtggtgtaaatactcccaccgtggccgatttcaagctaccaacgtgatgtcactgaatgsggagttgggaaaagatatacacaatcgactctcgtgagccgatacgagccagctccagcacaccactgg

SEQ ID NO: 203 - DNA, 439 bp, Homo sapiens
  repeat_region (1)..(439): mer63b
ccagtggtgtgctggtaaatgtttaacaactggctctctgggggaaagaaaaaagccctgatttgtagcgtttgccgatttccgtggtgtaaatactcccaccgtggccgatttcaagctaccaacgtgatgtcactgaatgsggagttgggaagagatgcacagtagcacacyattatatagtatttccaccatacagatacaatagacgtaaataacctcaagagcatagataatagtaaaatgtagtaaaataattaggaagtgatgagttttgagtatttattacctttgtttttaatataatttatttaattgtaagtttatataatttaaatttctttgtttttaatataatttatttaattgtaagtttatataatttaaatttcaatcggctctcgcgagccgatacgagccagctccagcacaccactgg

SEQ ID NO: 204 - DNA, 938 bp, Homo sapiens
  repeat_region (1)..(938): mer63c
  misc_feature (271)..(271): n is a, c, g or t
ccagtggtgtgctggtaaatgtttaacaactggctctctgggggaggwaatgymtkgatttgtgtattcacatatataagtttattataaattttactgatataaaggacgtrtagcacacaatttacaaataacaataaaatatacaatattctttattgtaaattccatatagccagttgattctcacagaatgctttcgttgatttttgcccaaactcttgtatccgtagccgaactatgtttgtaattgacgaacaagtgtagttcnaacatgaatgttggttgatattttcgtttatgttaatgagtaagatgaaagtgaaacaacgaagacgtatgtcagaacttcactcatttgtcaatgatgtgagtgacttctttgctgaatcggatggtagttttcaaacattagaagaatattttctcaatttttggtgctattcgcaatgtaacagctacagacatgacacacttttaagtttaatctgcatcattaacattttctccatcactttcttaagtctagacaatcaacaaaacaataaatcaagccctgatttgtagcgtttgccgatttccgtggtgtaaatactcccaccgtggccgatttcaagctaccagcgtgatgtcactgaatgsggagttgggaagagatgcacagtagcacacyattatatagtatttccaccatacagatacaatagacgtaaataacctcaagagcatagataatagtaaaatgtagtaaaataattaggaagtgatgagttttgagtatttattacctttgtttttaatataatttatttaattgtaagtttatataatttaaatttctttgtttttaatataatttatttaattgtaagtttatataatttaaatttcaatcggctctcgcgagccgatacgagccagctccagcacaccactgg

SEQ ID NO: 205 - DNA, 445 bp, Homo sapiens
  repeat_region (1)..(445): mer65a
  misc_feature (173)..(173): n is a, c, g or t
tgtgaaagttgtcagaatcaaaatggagtcacttatgttaaaaaccctaacaaayagagccggggaaggccatgaagagagggttctcacgcwcatatgcctgataacaagaactatcacaaaagactgcaaaaaccacaaccttgcacaaaggccatcacaaccttacacanaaaaatacttctacgaggacatctgcccagcaactgcctgtccaacctcggactggcgtcacccttgttattgatccttgtagccaaggataattatctcaaaacaattatgtaatcctcctcatttttcctttaaaaacctttgtcttcctttacctccctgaatatgcacatagtttactatggcacgcgtattcccattgcaatgctctattcccaaataaatatcattttcttttagagagcctctctgtttgttatttaggttgaca

SEQ ID NO: 206 - DNA, 531 bp, Homo sapiens
  repeat_region (1)..(531): mer65b
  misc_feature (173)..(173): n is a, c, g or t
tgtgaaagttgtcagaatcaaaatggagtcacttatgttaaaaaccctaacaaayagagccggggaaggccatgaagagagggttctcacgcwcatatgcctgataacaagaactatcacaaaagactgcaaaaaccacaaccttgcacaaaggccatcacaaccttacacanaaaaatacttctacaaggacatttgcctgacaactgtctcacraacctagctactgcaagagcctactgtaactctaagattacaaatcctacctagcaactgccgacactcgccaatcagagctcgccagctcttstaagacgctgctagcgccaatgaactttctttcaaaacaayttgtgtaaccttctctttccttaataaaaccctaacatttttctttgttctctggacataccgaaggccacctggtctgtgtgtatgccccaaattgcaattctgttcttcacatgttattcccaaataaaacgttttaaatttagggattcgtctctacattttattttgacttcgaca

SEQ ID NO: 207 - DNA, 461 bp, Homo sapiens
  repeat_region (1)..(461): mer65c
tgtgaaagttgatcatacgaattgggtcattcttgtcatacccaactaaaaccagggccgaggggcccagggggaaaaggcactcggggcgcatagcattgctccaaaatataattctctgcaaccctggctgctgaaactgcctgttgtaacctgaaaccagttttatctaacagctactgaaacaacctactgtgactctaagactagttttacccaccaccgtcactcaccaatcagagcttgccagctccccaaaactttactagtgccaatgaactttctttcaaaacaatatgtaacatttctcttttttataaaacctccaaccttctctttgttctttggacataccgaagaccacctggtctgtgtgtatgccccaaattgcaattctttcttcccaaataaaacgttttaaatttagggattcgtctctacattttattttgacttcgaca

SEQ ID NO: 208 - DNA, 4871 bp, Homo sapiens
  repeat_region (1)..(4871): mer65i
  misc_feature (818)..(818): n is a, c, g or t
  misc_feature (826)..(826): n is a, c, g or t
  misc_feature (833)..(833): n is a, c, g or t
  misc_feature (932)..(932): n is a, c, g or t
  misc_feature (1246)..(1246): n is a, c, g or t
  misc_feature (1253)..(1253): n is a, c, g or t
  misc_feature (1328)..(1328): n is a, c, g or t
  misc_feature (1510)..(1510): n is a, c, g or t
  misc_feature (1518)..(1518): n is a, c, g or t
  misc_feature (1635)..(1635): n is a, c, g or t
  misc_feature (1776)..(1776): n is a, c, g or t
  misc_feature (1780)..(1780): n is a, c, g or t
  misc_feature (2016)..(2016): n is a, c, g, or t
  misc_feature (2048)..(2048): n is a, c, g, or t
  misc_feature (2050)..(2050): n is a, c, g, or t
  misc_feature (2054)..(2054): n is a, c, g, or t
  misc_feature (2056)..(2056): n is a, c, g, or t
  misc_feature (2081)..(2081): n is a, c, g, or t
  misc_feature (2090)..(2090): n is a, c, g, or t
  misc_feature (2119)..(2119): n is a, c, g, or t
  misc_feature (2123)..(2123): n is a, c, g, or t
  misc_feature (2139)..(2139): n is a, c, g, or t
  misc_feature (3639)..(3639): n is a, c, g, or t
  misc_feature (3726)..(3726): n is a, c, g, or t
  misc_feature (3742)..(3742): n is a, c, g, or t
  misc_feature (3757)..(3757): n is a, c, g, or t
  misc_feature (3809)..(3809): n is a, c, g, or t
  misc_feature (3849)..(3849): n is a, c, g, or t
  misc_feature (4000)..(4000): n is a, c, g, or t
  misc_feature (1051)..(1051): n is a, c, g, or t
gaccaagacagtgttagaaatgagttcaaaatgaactcacctcagacaaatcttgacctctggaattgaatgcagcaatgactgagtcctttgtactctctattttcgtgagttccttttctgccctggcgaatcttctctcagattctcagactccctccctttggtgagtccttttttactttattccagatctgatttagttaaaagaccactttaaataaagaatcttacatcccttctgggaccataagtcttttttgacaagcactttctgatataaagacaaggatccttctggtttgagaactctagtttatattctgtctgtgagacatttattttctggtaaattcacttttgtttctttgtgcctgctgtgagacatttattttctggtaaattcacttttgtttctttgtgcctgttttaatattttgtttgatgtataaacctggctaaaaatttttgtgaatattctgattttggtgtcattttggtttggttacatgtgtctgtaaatgatttggctcttttttaccttatttgtttctaaacatcttccaagagcaaaaataaccattctaaatggtgagtgcaagacagccaattaaaagctagtagggtagtcgacgccatcgaaaataccagtccaaactcctgacattccctgacagtactgataagattttctctggtctcaagaaaaaaaagaacaggattctcaaaattctaaggcacgccaagtcttctaggactctagccagctatacattatggtctattctcgtgcgcgttytwmaactgatgggcaaacnacatcarnaaaaacncagaactyaaacggcmattwtctstctaagcttrtyaaaaactrcaaccaactatagagttaacatggagmrycttcatawgytctytgtctctctctnttttttctacccgctttgaatctgctgacttttctgccagtattaagataaactcattgcttatgggatttcagccaagattttytaaaaagagtytcaaaggactttcaaattaatgnctttacaaattacaacagctccatggcaacmammaacctagacaccytttggaaatgtaaattkaggtttgcctarctaacaattgctwagggcgatggaacagytaattaaaagattgatagtctaaaaagraaagaactagataaatgtttatraaagytaarggctstcagatcaaacaggtcaaaatcttnagctcanagcaataataaaaggtatctctgtctgrcataaaaattgctttstctgccacataggrgccagaaaragctgaanaaaaawaayaactgtaaatatctttttgaaaagtgcctttcccacgttaactagtcaaaccagactaacaaaaaacagatttgttactaattcaaggycatctggaaattttgtttttcttatacaattcagccagtcctagytaaaatgtaaacatttgaatattyaacctctaaactcanttgaatcnaataaaaggawwaaraggtttttaaaaatcaaactgccatgraaactgctttacccaaaattttggtccacagccttcattrgattacctatcggggcaaataaagcttagccacgnaaacargtcccattttgtcaaaaatataatttggatccaactgtcattttataaaccggcgagtttrtattactatgttttactgtctcatgactaaaattctaaaatgaaagctataagatctttgtgtatgtatgyatncgtntytatgtatgtttacayatattrtatgtrttgcatctaswtgataaaatctgacatagttarccagaattcccttttaaaaattctatttagattggcttaggtaaacgagcactcatrwaaawtatatagtaattaacccaaatgctttttagttcacgtgacttaagtaaatctttgataaataagtcggttttaaatttgttaataaaataaaaataaaaatatcttcaaaantgtcagcatacatttttgycyrggtttactgntnaganangattatatttatctctactagatgntttaaggtnataaaagtataaatccagmctaaaaacanaatnatctttgtttgtatanctttttgataagactaagactaattcgataytgttagtttaatgaaaacaactgtatyttctgtgttatcggcaaaatgcccatrtatttaagtttrrggctcttacttaggtgaacacctgatattcacaggctataaaaatgrttaamarggaaataacttgaaatgacgactagctttgtytamtatcttagttttcataagtaatcyagrtataattrttaaaaatgaataaagtacgtaaacgtaaatgagataaatgtgtgtaggtgaaaattctgtatagtttaaaatcttaaagttatgctatgttaaattaaatgatactcataaaatgtctaagtcatttccaaaattatatgaaaagcattttcaaatcataagtggtaaaggatgctaaacctttgctatgttatatttatggatatgttactgatatgattgttccagaaattgtataaaactctcagaaacctaatatgccataactctagttattatgtcatataccacagaagtaatgaaccttttatgtgagctgtgttatcataatgaattctcatcagagttttagccatagtcatttaaaatctttatcattcattgttattgttttgatttttctctaaaagcatttgcaatcactacatccaaaaatgcttccttttcaaggagatttatggaaacgatcgtgacaagaactctttaatacaagtttctgataaatttcacattataccaccgactgtctaaaaattcttcagaactctaataaggaaacagatgaatttgtgaaactacttctcagtgtaccaagcagggaaaaatattgatttcattgaaataattgataactgatgaggataatgttttttatgatttttatttgaaaatttgctgattctttacttaaatgttttgttttccagatctatggaatttttttcttttaaactgtttataacttacagcaatctggtaaagtatacttctgtgaaaacaaaagtaaaaacatttgctttttctccctactcgatccctccaaaatttggcaactattcatgagaattgatatgtttatggtaatacagatatttgcacaagtacagtaacagtctgctccctctttgtagcaggatacaactgagaccattggttatattaccaaggctttgactgggatgttatattcaagatagaatgaaccaatatgaactgcagggcaaagtctgaagtcaaccttggtttaagggttcctagacttacagcgggttgtaaaagtttaatctgagattccttataaaaacttagagcaaagaaaattttaaaagagagcctacatggtccattgtctgccttggtttggcttccctaaagaatcagaccatgtttgaagtaactcaacctattttgcaaacaaacttattctactgaaattatcattggtaaaactagagatgcccatagagagaaaagttatgtttctaaagaaaaactgnaatacgcctgttattagattgcagccctgtgcattgtttccgwgyttttattatcyacmtgwagackggacwwkaccccgaattctnctagyttcctccaatncmattttctcccatngaatcactaagarmaagacctactctgttcctgaagccctataagctgaagntggamaactcgatgtaaatwtcmwgggacaaamtctcgtncctgatgtgtgggccacacmragagttcaccaaaccgctcgatgccataaccagagacactcaaactgcaaaccaggacaagaagttgacggcttcacgctgtggacagtttttcccaagatgtcagaacaagactccccatcataatgangctcttacccctcttaaytktcctttcttatgcctgcctttttgacttggcaggataatggtgtaattgaaatttcacaatcagtagcttctgtcagtaacctcacagaacctgacctaagagatccttcagcccccctagtgggtgactttgggaacatccctaatacaactggtgctcactctgctttaatccaactcagtcatgggacactagatgataaaattgctctaaattatctattggttaaatcaggaaatatctgttctattgctaatagcacatgctgaacctggataaattcccctggggaacttgaggccccatatacacgaaattacaaaacataggttataacaggtcacataggttataatgggtctcacccaattccctatggtcatttgatttattcaactggttgtctttaagcctaggttcatagctcaaaactattatgaaaactgggggtatcatattactactaatattaatttgtattttccttttaacaatttgtacttgttacttgtgaagtctctgcagaagtacaactcctaacagaatcgtgctggcccagcgcgtccagatgatggccaaaagaccacagaacagaaaaaatagaatttaacgatggacttcaggtagacttagtctgagtgcaactctctccaaatttccactttgctcaaatgtggctaaatgagctctgacactgactcctggtcaccagtcacttcctgatgatgtggaaccagaccacaccaaactgggacagctccatcccagcaccaaggggcaatcaaagcctgactgcaggatgactggtcagctatgcttttggagaaagatctcaattaaaagggggaaa

SEQ ID NO: 209 - DNA, 478 bp, Homo sapiens
tgagataggaggtgggactcgactccggaggcggggcttgaactccagaccagattgaagactagctgaaacagggccagggcaaaagcacctctccataagacacacccaccggtgccawgtgagtttaccattgccatggtaacagccagaagttactgcccctttccatggcaatgacccggaagttaccaccccttttctagaaatttctgaataacctgctccttaatttgcatgtagttaaaagtgggtataaatatgactgcagaactgcctctgagctgctactctgggcgcactgcctatggggcagccctgctctgcaaggagcagtrcctctgctgctgctgtrcacagccgcttcaataaaagttgctgtctaataccaccarctcgcccttgaattctttcctgggcgaagccaagaaccctcccgggctaagccccaatttgagggctcgcctgtcctgcatca

SEQ ID NO: 210 - DNA, 486 bp, Homo sapiens
  repeat_region (1)..(486): mer66b
tgaggtaggaggtgggactcgactccggaggcggggcttgaacaccagaccaaattgaagactagctgaaacagggccagggcaaaagcagctttccataagacccacccaccggtgccawgtgagtttaccattgccatggcaacagccagaagttactgcccctttccatggcaatgacccgatgacccaaaagttaccaccccttttctagaaatttctgcataaaccgccccttaatttgcatgtagttaaaagtgggtataaatatgactgcagaactgcctctgagctgctactctgggcgcactgcctatggggcagccctgctctgcaaggagcagtrcctctgctgctgctgtrcacagccgcttcaataaaagttgctgtctaataccaccarctcgcccttgaattctttcctgggcgaagccaagaaccctcccgggctaagccccaatttgagggctcgcctgtcctgcatca

SEQ ID NO: 211 - DNA, 6676 bp, Homo sapiens
  repeat_region (1)..(6676): mer66i
  misc_feature (154)..(154): n is a, c, g or t
  misc_feature (194)..(194): n is a, c, g or t
  misc_feature (196)..(196): n is a, c, g or t
  misc_feature (377)..(377): n is a, c, g or t
  misc_feature (881)..(881): n is a, c, g or t
  misc_feature (1094)..(1094): n is a, c, g or t
  misc_feature (1099)..(1099): n is a, c, g or t
  misc_feature (1297)..(1297): n is a, c, g or t
  misc_feature (1983)..(1983): n is a, c, g or t
  misc_feature (2265)..(2265): n is a, c, g or t
  misc_feature (2761)..(2761): n is a, c, g or t
  misc_feature (2777)..(2777): n is a, c, g or t
  misc_feature (2944)..(2944): n is a, c, g or t
  misc_feature (3001)..(3001): n is a, c, g or t
  misc_feature (3281)..(3281): n is a, c, g or t
  misc_feature (3297)..(3297): n is a, c, g or t
  misc_feature (3305)..(3305): n is a, c, g or t
  misc_feature (3339)..(3339): n is a, c, g or t
  misc_feature (3341)..(3341): n is a, c, g or t
  misc_feature (3403)..(3403): n is a, c, g or t
  misc_feature (3566)..(3566): n is a, c, g or t
  misc_feature (3658)..(3658): n is a, c, g or t
  misc_feature (3705)..(3705): n is a, c, g or t
  misc_feature (3761)..(3761): n is a, c, g or t
  misc_feature (3764)..(3764): n is a, c, g or t
  misc_feature (3843)..(3844): n is a, c, g or t
  misc_feature (3847)..(3847): n is a, c, g or t
  misc_feature (3933)..(3933): n is a, c, g or t
  misc_feature (3961)..(3961): n is a, c, g or t
  misc_feature (4110)..(4110): n is a, c, g or t
  misc_feature (4139)..(4139): n is a, c, g or t
  misc_feature (4174)..(4174): n is a, c, g or t
  misc_feature (5316)..(5316): n is a, c, g or t
  misc_feature (5762)..(5762): n is a, c, g or t
tctggtgaccacgaagggacgaagacggcaagtgagagagagtgagagagccgagatggcaatcggtggagagacaagatggtgagacagtggcgatgacggcaatcagtgatcagtggagaggcagcaakcggcgagagatggtgagatggtnatcaaaagctgcagagcaataaccctgaggctgtaacaananagagctgctaacaccgcagagctgtaacactaaccaaaggctcttttcagagccatcatttttcctggcgggcagcggagccgagcggacaggcaagtggccataatactgccgcctcgtgtgggacccgctgctctgaccggcaggccagtgggttaccggtccccgcgcttgcccctcncgctgtggcagctgagcccacccaagctgagggaacctggggaagaccttcacccgggtcccacgtggaagaccagtcagcaccattttggctcctgtggacgggtgagtgtcccctctgatcccmccccataatatcgggtaaactagagaataaaagcctttggctaggtggtcagttaaaagtcccccatcgtttgggtgccccgagacacatccttgtcaccccttcccctggtcctttctcttctgactccattttattgctccactagccattttattttcagtcctaaaatgtatgttttgtttgcagtcttatttttgcttttgactttctgttgactgtttgggcaattgtttaaggcaggacacttggttgtgagaggtcccccattgtgttgactctgggacgccagagtcacgttgttctgtgaccccaactaggcctttggggttcactgttggccaccccacagatgctccggggttttcggcatttggngaacccctggawactctggggtttctggcatttggtgtggggaccctcattggcttgatactcaggtactccgggttttcagcattcggtattgttggccgccccctggatgctccggggttttcggcattggcattcctttcaggactgtgggttagagtcccatcctaggggaatcttggtcttgccttttctcgttttctgccctaaagnttatnattttctgtaacagcattttcttttcctattgtcactttatttacacttttccttctacactttgcttaataaaaacmcttttttgtcgtatttcattcactggcaaatactcataatccgcttttataataccttgctacctatactttgacagaaagtgggaatctaaaaggaaaaagtaacaaaggcccagttgnttttgctctcgctagacttagaaaaacttctgtgtccwgtagagatccttactagacatggggacaacgatgagcatcccagaggactcgccactagggtgtcttttaggcaattggagcaaattcaaattcagcttagagaaaaagaaactcattttctattgcaacaccgtttgggtccaatacaaattggaaaaccaacagatttggcctaggcatggttctttacattataatgmtattttacaattagatttattctgtaaaaaggaaggaaaatgggaagaagtcccttatgtacaggcttttatggccctctaccaggatcctgacctaagggmtagctgtagaatgtgtggctcatgwtacttccaggcaccaggaagctacaccagatatgcctaaaggaccccctcctagctgctccccctagaacgcctacgccctcccttcggagcctcctcagtcccccagttctgagaggggtcctaccagttctctaatacaggattccaccccaaggtcatcaggcacccctcctccttatccaacaagccccggcctataccccccgctgcccaaggaagtaagcccaaccagtaccaccaggagtggggccccgtatcagcccctaaaatcaaacctgtgtccattgcgggaggtagctgatggaaataggagaacantcagagtatatgtgccwttttccatgtscgatttggctttatgcaaggaaaaatttggccagttttcggaggatccagggaagtttatagaggagtttgttaagttgaccatgtcctttgatttaacttgkcatgacttgcaaatattattatccgcttgctgtaccgtagaggaaaaacaaaggattctaggtactgcccatgaacatgcagatggagtggctgtgtgtaacccaggccatgccatttactgtgtgggaggagatgcagttccagatctanaccttaagtgggattaccagagaggttttcaagatcttgaatgcagaaatcatatactaacttgtttagtagaagtggaagaaaaagtgtgtggttaagccagttaattatgacaaggttagagaaataactcggggaaaagatgaaaatcccgctctgtttcagggccgtttggttgaggcactcaggaaatatactaatacagacccagactccccggaagggcgagctctcctgggtatgcattttattactcaatctgcccctgacattaggaggaagctacaaaaagcagcaatgggaccccaaacccctgtaagccaactcttaaacatggcctttgggtttacaacaatagggacagggcagagaagaggcgaaaacaaaagaaatagccaaaaagcgcaattgttagtggctgctttaggccccctgccgcctcagggttacccacctcgagaaaatgtcgtgagatcggcgtctaggatgcccaganaagagccccccactcnccagcccctgggccaaaatcagtgtgccttctgtaagcaagagggccactggaaawaggatttcctaaccgwccccagtgagmtcggaaagcwtcgcgtcaataccagagctaacctccttccgctagcccccagmgagctgccttgcccaagtaaatttactaagngtctgggctcttgacctaatggacagcctcccamagcggcatacaagtggccgcttnaacatttttcttcagtgtctccactgccgggtaggttctctggcgastcggggcctccgaggtctccccttgagcaatgcwgttcaccctgctcccttccttatktgatgctatgkgatcwtcttccctgcctcttcctgtcttccatacctactggkgcwaacaaaatttggccaggtaggtgggtcccaawtttgtaaataacttggatccagttgcctwgtatakgtcattttacttkgtgtgtttaagtstmtgtamaggttwaatgtgtgctgtntttagcaggctatcanattggctnagaawtaaaagagtgctcgtgaattaacacaagncnagtctagacttattcgtttgaaaaatgttacgtcttctaaaatttaactctaagatttttanctaggtaaatcactgatgtgcataggctttaaaatggttaaaatggccamwggtcgttaaattcgcatgggaccttggttcttggaggtggtctaaacatagctattaaaagtaaaaatgttaaacacatgtgaatggaatagatgcttaaatagtgagcttnttgtacggtttaaaatcttaaaattgtaaaatagttctcatctatagaatkccaatgtctggtgggcagttcaggatttcttgctccctagntttatataaaatgtgccaaagaaatgtattttttattgggaaaaaangttttcgtctaatttggaagttattaaaagggaggttcaaaatataaggaaaccantgngtagaaaagagagatataaagaatgttatggatagaaaatgtattttttgcaaagaatatataaaaaagagtaattttnnatnaagaggaatcttgtatagtaaattcttgtcctaaagtaaaatgaccggttatttaagaaagaggtagtataggacaagtaagaaankccaagcatgttgtagatggtctgtgtnagtcatgataaggttcatgaaggggaatttataaaaagaatttttgtgtatgattaagcttgctataattaaaagaaaattgtttacaatagactttctaaagaatggtctacgtttkaaaaccgaattttcttaaggtattaatttgntaaattaccagaaattttgtttttcaatnctgtaakctagttcttttgaaagcttctcagcganttcatgtaactctmtcctttagctttttcgtcagctcctgtgagttttttcctctagttctgttgttgtggcctgatgctaaagtgttttgtcttagaggtctgtgggagcagtgttttcccccagtatagtttctattgatataatcttatttttggcttttagtttttgactcttacattgcttagaagggttttaagggctaatgagtgcctgcccacctccattcccgtctggcctagaacgtttaattggctataagtcttttgactctaagtcccttggscaaaggaaattccaaagaaacttaaaaactaactcaggccatgacaggaaacagggggttagacatacctcactatgccccctttwmaatttaggctaggttcacaaggcccttcaagaatatggaaataaagtattgcctctcacaagacttagtcttactaaaaacttaaaaagaaggatcccctgaggatcaattacaaccaaaatggaagggccctatcgggtattgttaagtacccccactgctgttaaacttcagggaataactagttgggtacamctgtccaggattaaacctgtttcttatgagtcacaggcacaaaaggaggacaccatgacctacatctgtgaacctttggaagacttccactacctatttaaaagaatcaacactcagccagaagtggtaacgtgatgctgtgggtgggaataggagcattaatttttctcttcttcctgattgtaatacttcttttctatcgctttagccaaccaccttctcctgggaaacacctcttttgtccttgttgggtgtagaggccactctaaggcccaaccggataccatgctgtcactgttaatcctgtttgctctcccaattaccctgatccagtgtgggtgggaacaaaactctatagtaaatatttcaaaaattatagcatcagggaatcatcttcatggttgctggatttgtcatcaacatccccaggatagagagttccatcttctggcctatccggaaaatctcacagccatctccccagacctcctaactaaccatagcaatcccgaagtacccaaacccctacttgttaagtggaactctcccccacttaacggattccacctgaacntccccmaccactattacctggacctgggaagttgggtatctatatctccagtgcactaatgattctatcttttgcacccactgttgtgttaatgacacaaaagcggaagtttccctgcgatgctctgatccaactctagttgccaagttcccaaggccgcagcaaggtaaatgggattccacttgtaagcgaggagaccatatatggtgccttctcctggatcagaacatacaggggaaaaacaactgcctaatctgggaaggtgggagtaccgcccccttctggaaaacaaagattgttcgaccacccccattggaacaggggaagaatatctctatagacccaacttggcagcaaagaatagacatcacaccccgtagggcctccgtttgtgccccaactgggctcatttttgtttgtggccatgaatgggaagaagtcacacnccgtaaccactcccgactccccagggagccacctgttcttttaggagtagctttcccttgtatatcaaaaacttggaacagaggtgaatgtacgttggccacccttgcccctccaggggtcacagtctataaccccataagacccaggaacaccagaagtaaacgagcaataggattaattctggcgggaatcggggcagcaataggactagcagcaccctggggtggctttgcctaccacgagtcaaccctaaagaacttgactcaaaccctagaatccttagccaccaacacaggtcaggcactaaagagaattcaagagtccctagactctttggcaaatgtagttctcgataacagactagcattggattatttactagctgaacaaggtggagtctgtgcagttattaataaaacctgctgcacatatattaacaactctggacaggttgaggttaacattcaaaagatctatgagcaagctacctggttacatagatataaccagggcactgaccccaactatatctggtcgactatcaaaagtgccttcccaagtctcacctggtttttacctctcctaggacctttgatagctgtcttgttattactaatttttggcccttgcttgtttaacctcttagtaaagtttgtgtcttctagattacaacagttccaggtaaagacaatgctggcacaaggcttccaacccatcccgtctactgacccggagaatgaaagcgtcctgcctctgggccccttagatcaggtatccagagatttttactcctccggtgctaggcagggcctatgcccataaactcagcaggaagcagttacagaagatggacctccgcccttctgcagcccccttaagattaaggaggagtatctaatctctgaggggggaa

SEQ ID NO: 212 - DNA, 543 bp, Homo sapiens
  repeat_region (1)..(543): mer67a
  misc_feature (375)..(375): n is a, c, g or t
  misc_feature (386)..(386): n is a, c, g or t
tgacaaagattctctccttgaccaaactctagccaggctcctctgagcccccttctccactaggcctcaacctcggcctataaagacttgaacaaacactaacatagtttctaatagctcaaggccacatccctaggatgaccctagcccccccttaaagtgcctgcctgagaaaactcaaggctgccaaaataatttactgtttgttccagccaacacctgaagatagggcccctgtctcccagtctctgtgggagggtaggagcctaacttcgataagcgccagttagcaaacacagatgggctaatcacattkacactgwccaaccttttgtaatttttcacttccctgactctactgagcccccacgcgtnccctctccccnctccctcattctccctttaaaacgcccagtcacctctgcacaaatcgaagctgagctcagttcacgctggactcttttccctactgcaatagtatattactgattaaaatccgtccttaccgctttaactagtgtccggctttgtttatctttgaca

SEQ ID NO: 213 - DNA, 661 bp, Homo sapiens
  repeat_region (1)..(661): mer67b
  misc_feature (414)..(414): n is a, c, t or g
  misc_feature (507)..(507): n is a, c, t or g
  misc_feature (518)..(518): n is a, c, t or g
tgagaactgcagaactctcggcacagaacaactccatccaaacccctgcactaagagacttgaccaaactctagcatggcttctagcagcataaggccgcgtccctaggatgaccccagcccccccttaaagtgcctgcctgagaaagctcaacgctgccaggagaatttactgtttgttctagccaacacctgatgataggcccctgatctccctttcttagagcatttactaaaaagggcttacaattgtgaatccttcctctgtccctttgagatatgtatgtatctcctacaactcaggagtgtctttctcaaggacctgagagccattcctttgaaatgtaatcatcgagaaggatagggcctctgtctcccagtctctgtgggaggatagaatcctaactttgataancgccagctagcagacacagctggcctaatcacattgacactgaccagccctttgtaatttttcacttccctgactctgctgagcccccacgtnccctctccccnctccctcattctccctttaaaacgcccagtcacctctgcacaaattggaatggarctcagctctttcccctactgccagtagttactgaataaaatccgttttcaccgctttaactagtgtccggctttgtttatctttgaca

SEQ ID NO: 214 - DNA, 710 bp, Homo sapiens
  repeat_region (1)..(710): mer67c
  misc_feature (36)..(36): n is a, c, g or t
tgtaagggcaaatacaaattaaaaataagaggcttnaattctccctggtgcgaaaagagaaagacaccctcctctcccttttcttagagcatttactttagaaaacttgtaattgtgaatcctttctctgtccctttgaaatgtatgtaaatctttttaaaagctaaataagcctcttgccagctttacgacccaggaatgtctttctcaaggacctgggagccatctctttgaaatgtaawcatcaaggaagatagtacccctatctcccagtttctgtgggagggtaggagcctaacttcagtgggcaccttgctccaagttgcaaaactacctcctgtcataaagatatgagaagtttatttttcctttggataaagccaattagctaacacagatggccaccccaattaccaggtgaatttaggatgaactatgtgtgacaaatggtgctgtcaagtcctcttacttgaggactagttattgtttatcttgagaacatgtatgtaatgggctgtatctgctcggctatataaaagggtgagatttctttctgtstttgcaatctcttagcagattgcctgtgatgcgcatcacattctggtttaatgcttattcaataataaaacgtgttttctttctcttctacctttgtggagaggttttctgggttgggagragattttgtttttaattatatttccccaaca

SEQ ID NO: 215 - DNA, 514 bp, Homo sapiens
  repeat_region (1)..(514): mer67d
  misc_feature (279)..(279): n is a, c, g or t
  misc_feature (397)..(397): n is a, c, g or t
  misc_feature (412)..(412): n is a, c, g or t
  misc_feature (427)..(427): n is a, c, g or t
  misc_feature (488)..(489): n is a, c, g or t
tgaccaagacagccttaacgttcccctcagcttgactraactttagacaggtttcttcctgactataggcccctgacctcccttttcttagagcatttactttagaaaacttgcaattgtaaattctttctctgcccctttgagatgtaaatcttctacaacccaggaatgtctttctcaaggacctgggagccatccctttgaaatataatcawggaaggacatagggtccctgtctcccagtctctgtggaagggtaggagcctaactttgataagnagcaattwgcaaacacagatggcctaatcacattgaccaacctccccaccaacgtcctccagtacttttccactagctcaccccagcgcttaaaaatccacctgccttttgtttcagnggagttgagttcaanctctaacccctattncaatagtctctgtcctttattgcaatagtcttgaatgaagtcttccttgcctgtttaacanntttccggtgcaatttttcttttaca

SEQ ID NO: 216 - DNA, 563 bp, Homo sapiens
  repeat_region (1)..(563): mer68a
tgtgcagaaaagagttaacatagcaggcctgagactgctatccttagaaaggcctgcttgcaaggttggcccttggctggcatctgggaacttggatttcgggagggttcccaccattcccwkaactgataagagtggctcactgtgcctaaactgtttgtgcaaacaatatggtttatgctgaacacctgctttccttctgggagtctggaattttggtacgtgctaggcagagggtgcctacgtgaccagcccccartaaaaaccctgggcactgagtctctaatgagcttccctggtagacaacatttcacatgtgttgtcacaactcgttgctgggggaattaagcgtgtcctgtgtgactccactgggagaggactcttggaagcttgcgcctggtttcctccggacttcgccccatgcgccttttccctttgctgattttgctttgtatcctttcgctgtaataaatcatagccgtgagtatgactatatgctgagtcctgtgagtcctcctagcgaatcaccgaacctgggggtggtcttgggaacccctaacaca

SEQ ID NO: 217 - DNA, 568 bp, Homo sapiens
  repeat_region (1)..(568): mer68b
  misc_feature (461)..(461): n is a, c, g or t
tgtgcagaaaagagttaacatagcaggcctgagactgctatccttagaaaggcctgcttgcaaggttggcccttggctggcgtctgggaacttggcttttgagagggtccccaccgttcccttaactgataagagtggctcactgtgcctagactgtttgtgcaaacaatgtggtttatgctgaacacctgctttccttctgggagtctggaattttggtacatgctaggcagagkgtgcctacgtgaccagcccccaataaaaaccttgggcgctgagtctctaatgggcttccctggcagaaacattgcacacacgttgctgcattttattgctgagggaagtaagtgygttctgtgtgacycctctgggagaggacmywkggaagcctgcgcatggattcctccagactccgcctgatgtgtcttttccctttgctgatcttgccgtgtatccttacnrtgtcgctgtaataaatcttagccatgagtataactgtatgctgagtcccgtgagtccttctagcgaatcaccgaacgtgggggtggtcttgggaacccctaacaca

SEQ ID NO: 218 - DNA, 179 bp, Homo sapiens
  repeat_region (1)..(179): mer69a
ccagaggcagatttaccgtgaagctaatgaagcttaagcttcagggcccctcacttgcataggccccttccaaggccctgtacctaattttgtattcgtaattttgtattctttttcttaaagagggccccccaaattgtataagcttcaggccccacaaaacctggatctgcccctgg

SEQ ID NO: 219 - DNA, 1501 bp, Homo sapiens
  repeat_region (1)..(1501): mer69b
  misc_feature (800)..(816): n is a, c, g or t
  misc_feature (743)..(743): n is a, c, g or t
cagaggcagatttaccgtgaagctaatgaagcttaagcttcagggcccctcacttgcacgggccccttccaaggccctgggaggggccctagcaatgtgttcacatggtcatatgtttttgtaaaatttgcaaaagtaagatattttaaccacaattggttaagactgctgtctctttccactccgacttcccctccatcacacttcccctcatgtcgggtggtattggagtggccgtgggcatttttgggatctggctaagggaaagttgagttggggatacatttagtttgggtttagtgggatatatttatgtggttcgcagtcacttccgtgtatagttaagttattgctagccgtcccggtataggaatggcttccaggaayattcctactgcccactgtgccgactcacccagcgtcgtgacmtgaggcacaggaccggagrtcgtatcgcgatatgaacgtgtcctacggcacctggcaccggaagtatgcgggtagtggaggagaaacaaggtttgaaatgtacagagccagaagctagtctgtggaaaattcttccaatcatcagacgtgtaaaattgtaagcggaggattcggttctcatcgatgcctagycagagcagaagttctctcctgtcagaaatatactcgataatgcagcgtatacaattataaatgcamcatgcatttatttgcatttttggaagggaatcatgcgaaatagaatttatcagaantccttgtttgtagggcacagatctrtagcagtactacaaacagtgagcacatctgtnnnnnnnnnnnnnnnnnttattaamtttcttgctgatatgacatgaaatwctgacgttaacgaagataacasttcacttctaatttaccatgacaaaaaagacatcagtgacaaactggttactgagtgtcattaattctaagagyatttaagattagtcactgcacaagaaaacttgaaatgccctgaaatcttacagctcatatatgaaagaaacttgataggggtttccccaaatttgacaacaattctaaaaatttacatgacattaccaataacgagttgtgaagctgaaagaaacttttctaaactatcaataataaaaaacaaatttcgatcaaccatgctagaggaaagactgaattatctttctattctctctatagaaaatattacaaaatcgttgtcatatgaagaggcgatcaaagagtatgcagccaaaaaatgtagggaaaaartattatagaagtgtgtcaggcagttaattaataaaaatatggtgttgtttttctggattttgtgatgtttgtggtatttgtcaactttttaaaatttgtaatttgttgcgatttcttttctcattctaaataaatattcacttttgtacctaattttgtattcgtaattttgtattctttttcttaaagagggccccccaaattgtataagcttcaggccccacaaaacctggatctgcccctg

SEQ ID NO: 220 - DNA, 597 bp, Homo sapiens
  repeat_region (1)..(597): mer70a
  misc_feature (99)..(99): n is a, c, g or t
  misc_feature (143)..(143): n is a, c, g or t
  misc_feature (159)..(159): n is a, c, g or t
  misc_feature (437)..(437): n is a, c, g or t
  misc_feature (460)..(460): n is a, c, g or t
aagcagattcgctaattaccagtcccaagagaagactcctactgcgtggagaatagcgaagatcatcactatgccaaccaccaggaacttcttcccggnccactgcatcytgrgctacwgtttatgtccwccatgcactggtnacctcgcttacccgantccggtgagacagaacgcgcgcacacacaagttacgcgaagcgggtttattacttacagacaggcagcaagggacaacagaagcctaggattcagggtragyymgtcycccaaggctcaggaaagctgcccagggcggatggaatcttgwctgcgcgtgccccacttgcactgcagctgagggrccccggaaggcaccccgccctgggttttatacctcaggaacmacatgacacgctgggctaaagcgttgaaggacatcctgtttcyaggagaganwggaacagagcccaggctgttcnggccagttcctccctatctcaggatgttgcattcccagcacattctacagttattcttgagaactacaagcaagaaagaggggagwactgggtcggtccaaggccacctggrgaactgtcctgcagagctatccgag

SEQ ID NO: 221 - DNA, 665 bp, Homo sapiens
  repeat_region (1)..(665): mer70b
  misc_feature (99)..(99): n is a, c, g or t
  misc_feature (143)..(143): n is a, c, g or t
  misc_feature (159)..(159): n is a, c, g or t
  misc_feature (437)..(437): n is a, c, g or t
  misc_feature (460)..(460): n is a, c, g or t
aagcagattcgctaattaccagtcccaagagaagactcctactgcgtggagaatagcgaagatcatcactatgccaaccaccaggaacttcttcccggnccactgcatcytgrgctacwgtttatgtccwccatgcactggtnacctcgcttacccgantccggtgagacagaacgcgcgcacacacaagttacgcgaagcgggtttattacttacagacaggcagcaagggacaacagaagcctaggattcagggtragyymgtcycccaaggctcaggaaagctgcccagggcggatggaatcttgwctgcgcgtgccccacttgcactgcagctgagggrccccggaaggcaccccgccctgggttttatacctcaggaacmacatgacacgctgggctaaagcgttgaaggacatcctgtttcyaggagaganwggaacagagcccaggctgttcnggccagttcctccctaamtcaagatrttacattccctaggagggkcaagaacaaggccaasctgttccgggcagttcctccctatctcaggatgttgcattcccagcacattctacagttattcttgagaactacaagcaagaaagaggggagwactgggtcggtccaaggccacctggrgaactgtcctgcagagctatccgag

SEQ ID NO: 222 - DNA, 711 bp, Homo sapiens
  repeat_region (1)..(711): mer72
  misc_feature (20)..(21): n is a, c, g or t
  misc_feature (23)..(23): n is a, c, g or t
  misc_feature (28)..(28): n is a, c, g or t
  misc_feature (249)..(255): n is a, c, g or t
  misc_feature (309)..(309): n is a, c, g or t
  misc_feature (385)..(385): n is a, c, g or t
  misc_feature (474)..(474): n is a, c, g or t
  misc_feature (681)..(681): n is a, c, g or t
atgaagacagcgtwctcttnngnattancatgataaataaaaatraaatcctaaracccccaaccgactgarcagaccacctcttggccgaggggaccccagagwaaccttgaaarctgagttcycggccgkgacgggatggagggrtcagacacacctcgttrtacccctcccttrctaaccatsaykrggcttgcytccctaargrctaaacagaaaccagcyctttcgaaagactccagcactgrnnnnnnntcctttccttcctgrtaagagaccaccraccacggagwgkttctggccagtctncggaggatgtrcagcgagggttttcgtgtcctctgcttcaccttttgacgtcagagggccgaaaactccaccctcngatcatgctaacactgccaktttttgwacatgggwcccatgaagaggcaggaarctcaattgtgcacgcgtgtgtttctccyttcacgnatattcatgactcctcctatagcttattgaatatgtatatttggccatyccactcagcataaattcctgttccctttgccyctccctcgaaatgtctgtttctggcttctggccggaggctacgcttcccagcctgtcagaatggccgccctgcaggctgcaaccctttatgagaaataaagctctcctttccaaatttgaacctcntcattcttcagttgacaaagtrkcaaarat

SEQ ID NO: 223 - DNA, 636 bp, Homo sapiens
  repeat_region (1)..(636): mer73
  misc_feature (108)..(108): n is a, c, g or t
  misc_feature (290)..(290): n is a, c, g or t
  misc_feature (472)..(472): n is a, c, g or t
  misc_feature (614)..(614): n is a, c, g or t
tgtcataaatttgtttaatacagttgctgcctcggcatccatttttaggcctgacataagttgtttgaaacccagtcgtaccccgtcacctttggcctagttaaaacntctcctccctgtgtggttgtttgcgatatggcccacttgttcctcatctcgctgacccaaaacccaacacaccccacagctgctgaccatgataaaacctaatggtcaacgccagagtcatgtaaataagtttcctccttctggcatgttttctttaaactagccaatccacaacccccgtnggaaagcctgagggataatgcccatggaccttaataaaggcatactcccgcagctgctctctccctccctacccactggttgagctccctgccgcctccagacttcccatcggcctcccgtcggcacccctaacctctctgggatctgtaagtaatamatttcttctgtttcatgcattttngtttcacttgcctcactgtgtctcmcctgacacacacactcgaacctaactttcccccgggtcagggctctcctagaaaatggctatcttggcttatggccactctcaagagagagacctcaagaccaaattagaaagaaancataacgataaaaatcacaaca

SEQ ID NO: 224 - DNA, 624 bp, Homo sapiens
  repeat_region (1)..(624): mer74
  misc_feature (314)..(314): n is a, c, g or t
tgttttaaaatgtaggttttattatttaggtatgttraggccaacagatcaggagacgactgccattgaaaagacagtttgttattctcacagatcccaagagaagggggcatgccgcgccacggggagccccacggggaagcaccggggtcggtcaggaggcagaaggagcgacgggaaaacgtrggcaagagcctttattgtggtttccatgggaaggaatgrgcgaggcagggtaagcaggcttaggattggctagtttgaataatttcagcaggctctggggyataggggytgtccctagttgcctggtncctggccctgggatgattagggcagggggatagtggcccagagtgtaagagccaaatagaggaggtggttgggggtatgggctctggattggttggtttgcatatgaaaggcgcgctcccgggcgagtccttcgctatctctaagaattggctagccctgggaggggcagtctctccgggrtcagcaaggccccaagatgtcaaarcatyataaaatacagaaaataaaaaagcatgattaatacaakytgctctgtgatgaacggatgccaaatagwcgaatacagaatctaagaaaacacagaacaca

SEQ ID NO: 225 - DNA, 558 bp, Homo sapiens
  repeat_region (1)..(558): mer74a
tgtattaaccatgttttttattttctgtattcttgatgctttgacatctggggccttgctgaccctggagggactgcccctcccagggctagccaattcctagagatagcaaacgactcgcctgggagcgcgcctttcatatgcaaaccaaccaatccagagcccacacccccaaccacctcctttatcgggctctcacactctgggccactatccccctgccctaatcaccccagggccaggtaccagacaactagggacagcccctataccccagagcccgctgaaattattcaaactagccaatcctaagcctgcttaccctgccttgcccattccttcccatggaaaccacaataaaggctcttgcccacgttttcccgtcgctccctctgcctcctgaccgaccctggtgcttccccgtgtggccccccgtggcgtggcgtgcccccttctcttgggawctgtgagtaacaaactatcttttcaatggcagtcgtctcctgatctgttggccttaccatacctgaataataataaaacctacattttaaaaca

SEQ ID NO: 226 - DNA, 622 bp, Homo sapiens
  repeat_region (1)..(622): mer74b
  misc_feature (51)..(51): n is a, c, g or t
  misc_feature (54)..(54): n is a, c, g or t
tgttttcttagattctgtattcgtctatttggcatccgttcatcacagagncanttatattaaccatgttttttattttctgtattcttgatgctttgacatcttggggccttgctgaccccggagagactgcccctcccagggctagccaattcctagagatagcaaaggactcgcctgggagcgcgcctttcatatgcaaaccaaccaatccaaagcccatacccccaaccacctcctttatcgggctctcacactccaggccaatattccccctgccctaaatcaccccagggccaggtaccaggcaactagagaccacccctgtaccccagagcccgccagaattattcaaactagccaatcctaagcctgcttaccctgccttgcccgttccttcccgtggaaaccmcaataaaggctctggcccacgttttcccgtcgctccttctgcctcctgaccgaccctggtgcttccccgtggggctctgcgtggcgtggcgtgcccccttctcttgggaactgtgagaataacaaactatcttttcaatggcagtcgtctcctgatctgttggccttaccatacctsaataaaataaaatcccaggtacattttaaaaca

SEQ ID NO: 227 - DNA, 514 bp, Homo sapiens
  repeat_region (1)..(514): mer75
  misc_feature (86)..(86): n is a, c, g or t
cccttttcccgtttgccccgagaatactcgccggcggcgcttgcggctgcagcgtttaccccgagataactttgccatgaaatatnttgcttttattattattttcgcatcgttctagtatatcgactttggaaacaaaagacatcgttctatttatagcattctgtttttagtagtggtatttccatttacaaaatatagtaattctcgattgctgaaaatgtcaaatcctagaaaacgtagcattcctacacgtgatgttaacatcgttctcgaacagttgttggccgaagattcatttgatgaatccgatttttccgaaatagacgattctggtgattcagatgattctgatgttagttctgtttagaaataactccaagaacagtttttatattttattttcacattgaaaatcagtcagatttgcttcagcctcaaagagcgtgtttatgtaaaattaaatgagcgctggcagcgagctgcacttttttttttctaaacgggaaaaggg

SEQ ID NO: 228 - DNA, 688 bp, Homo sapiens
  repeat_region (1)..(688): mer76
  misc_feature (336)..(336): n is a, c, g or t
  misc_feature (387)..(387): n is a, c, g or t
  misc_feature (393)..(393): n is a, c, g or t
  misc_feature (514)..(514): n is a, c, g or t
  misc_feature (636)..(636): n is a, c, g or t
tgaggagtccagctcctggcyaaaaacctacgtgtgatttttcaggcctgaccataggcaattacaaaggctttacctggcaggcctcatgggggaaagctgccctccccacaccagacttggtgcacagccagtgcattgcagtctctgaagggagttgcagtcaaggactcaggcccccctggccggccacgctcttacacatatctgcattcctagcccaggcgcctccgttcggaggcctctttattcggggccttctgcagaggtcttcctcaggcgcctctgccgagacctctttatgaggggtggaagcgggagccttgaagacatttntctccactctgactcagtactcagtgcttttccactcctatcccttccctntcctcncctccatgacccacgggtccataaaactgcaggagccttttgttcagggctccctcaacagtgagatgacccccatgtctgtgccgatccacctgacccttgaccggtgccatttccatgnggaaaaatggaacatggggagtcggtactttctctggttttagcctcttgcttatactatcgaagkaagtgattaaagatttgactgttactttcattttggcttgttgccttaatcggctnctctgacacccggcagctcagctctctctccagctcagctgagctcctgaca

SEQ ID NO: 229 - DNA, 650 bp, Homo sapiens
  repeat_region (1)..(650): mer77
  misc_feature (166)..(166): n is a, c, g or t
  misc_feature (170)..(170): n is a, c, g or t
  misc_feature (335)..(335): n is a, c, g or t
  misc_feature (337)..(337): n is a, c, g or t
  misc_feature (348)..(348): n is a, c, g or t
  misc_feature (393)..(393): n is a, c, g or t
  misc_feature (412)..(412): n is a, c, g or t
  misc_feature (608)..(608): n is a, c, g or t
actacggggggaggtgtcaaattcaaaggtctccaagacmaccctcctgtttartgattcgctagaaggactcacagaactcagaaaagccgttatactcacagttacggtttattacagtgaaaggatacagattaaagtcagcaaagggraaaggcacataggncagngtccaagagarmcaggcacgrgcttccagttgtcctctcccggcggagtcgtrcgggcagcgcttaattctcccagcaacgrtgtgtgacagcacgcatgaagtattgccaaccagggaagctcacccgagccttggtgtccagagtttttrttgggggtcggtnanataggcatggntgaccccgcagcatggctgaccttggtcttctcaggcttgagccncccaagcatggctgacctnagttactcagtctycagcccctccagargtcarryaccgtgtagcctaaggcccccaccataaatcacattgttagcatrractgtccggtatggcccaaggccytcgcagataaacaaagayactyttatcaggcaggacattccaagggcttagaggttatctcccarrgcctgaggataamcgagggccaganctttctttgggcaaggttaatcctttactgyayaagaccaca

SEQ ID NO: 230 - DNA, 239 bp, Homo sapiens
  repeat_region (1)..(239): mer8
  misc_feature (19)..(20): n is a, c, g or t
  misc_feature (102)..(102): n is a, c, g or t
cagttgtccctctgtatanncgggggattggttccaggacccytgtgtatacmaaaatccgcgcatactcaagtcccgaagtcggccctgcggaacccacgnatatgaaaagtcggccctccatatatacgggtttcgcatcccgcgaatactgtattttcaatccgcgtttgattgaaaaaaatccgcgtataagtggacccacgcagttcaaacccgtgttgttcaagggtcaactg

SEQ ID NO: 231 - DNA, 508 bp, Homo sapiens
  repeat_region (1)..(508): mer80
  misc_feature (441)..(441): n is a, c, g or t
caggggttcttaaccttttttgtgccatgggcccctttggcagtctggtgaagcctatggaccccttctcagaataatgtttttaaatgcataaaataaaatacataggattacaaaggaaaccaattatattgaaatacagttatcaaaatattaaaaaaccaaatttgtgatatagtaatatatgtgcttctttattaatgcattaaataacaagatctagcggcgggtctaataactaccgtaatttcgaagtagtgatgagcataaatgatattttgagatatctgcaacaactgtaatgtgatatgaaaatatctgtgatttctattggtgacaaagtcacaggtactgctaatactactgtggtttgttgcctacattcataattgaaggaaatgctaaatttcagttagaggttagtgaaaataaagatgtaanttttttccccatccaagttcacggaccccctgaattctatccatagactccaggttaagaacccctg

SEQ ID NO: 232 - DNA, 114 bp, Homo sapiens
  repeat_region (1)..(114): mer81
tagggtgaccaaccgtcccggtttgcccgggactgaggggtttcccaggacgtgggactttcagtgctaaaaccgggaaagtcccgggcaaaccaggacgagttggtcacccta

SEQ ID NO: 233 - DNA, 653 bp, Homo sapiens
  repeat_region (1)..(653): mer82
  misc_feature (186)..(187): n is a, c, g or t
  misc_feature (544)..(544): n is a, c, g or t
  misc_feature (557)..(557): n is a, c, g or t
  misc_feature (567)..(567): n is a, c, g or t
cagttgatcctcattatccacagtagttatgttctataaagtcaccgcgagcactgaattagcgaatactgaaccatcgctcctagaggaaatacagagttaggttcctgcaagcctctggtcacaacattttcatcaaccgatcaatatataacyttgttttatgtgtgtttctgtttaaagacnncttatttaatatatattgttgatttattaacactgaactcacagccaacagcactataactcatgcctgaatgaagcttatctaacacacatattttctccataaggtacatcacagccttcttgtgcttaggaacaccagacagcacttcagcactatgctcggggccattttaaacggcgaaatcaccaacaaaaagcacaaaaatgtgaaaaacgtggcactaaatagacctcgaaaaggacgcttgtttacggtatgagagctgaaacaagaaggcagagcgtcgccttgttcgacctcagctgggaacgtgcacgtcgggcgactcgaatttttcgctgctctgcgcatgtntgcaaatgaccgngaaagtgctncaagtattgattttggggttacaaataaattttagcgagtaggcgaattcgcaaatacggaatccgtggataatgaggattgactg

SEQ ID NO: 234 - DNA, 441 bp, Homo sapiens
  repeat_region (1)..(441): mer83
tgtggagtcctaattagggaaaaggagtcaggctggcgggaccaggggaaagcaaagggagaaagcaaataagctataagtctgcctttcttcatggtccaggacacatagccctcctgcgcaaataactcacaatcttcctgcgcccaactattatcaaacacctcagctgacagaaaaatgcaagttagctcmctgcaaccttggcattatcagtactgcacgcagcmctctgcagcccaagaaccatcctataaaatctccagcaagcctttgtctccttgcagtcagctcctctcttgctggtctgcctgttgcttccttgcaacatattttcatactttctctaataaatctgcctttctttacctacaactgtcttggtaaattatttttacctcccgcgccaccggccccagatagtcgccgctccccacgrca

SEQ ID NO: 235 - DNA, 378 bp, Homo sapiens
  repeat_region (1)..(378): mer83b
tgtggagtcctgataagtaagcaacaatgaggaaggggccccaggtgggggagggccccaggtggggaagaacaatgaacaattgttctgagagacggctaatcacaaacaacccgcgggcacaacgacctcgttccgcatgtagccccagcagcatgacctcattctgcacgtagccccctccagcacgaccctataaaacttccctccagcccctgcctctttgcagacagccccttctctgctgtgctgcccgttgcaaccttgcaacgtattttcatactttctctaataaatctgcctttctttacctacaactgtcttggtaaattcctttaccgcctgcgacactggccccagatagttgcacccgtgaca

SEQ ID NO: 236 - DNA, 373 bp, Homo sapiens
  repeat_region (1)..(373): mer83c
tgtggagtcctgataagataagtaagcaacaatgaggaaggggccccaggtgggggagaacaattgttctgagagacggctaatcacagacaacccgctggcacaacatcctgttcccaaatacctcgctccgcatgtagccccagcagcacgacctcattctgcacgtagccccctccagtacaaccctataaaacttccctccagcccctgcctctttgcagacagccccttctctgctgtgctgcccattgcacccttgcaacgtatctttgtactttctctaataaatctgcctttctttacctatgactgtcttggtaaattcttttactgtccgcgatgccggccccagccagtcgcacccgcgaca

SEQ ID NO: 237 - DNA, 508 bp, Homo sapiens
  repeat_region (1)..(508): mer84
  misc_feature (133)..(134): n is a, c, g or t
tgaggagagcaaagaccacctggtgaccatcaaacaggccatccggaggcaaaactccttatctggggaatttagaagtaattagacttccctattatctaaagcaggcatctggttccaggcctctttcccnnaaaaacttataagtaactagaatttctatacgtctccggaatgcatgcatgctgaaactcactgtgcaacccttgctgacatcaaggcaccaaaatgtctacaaatgtaatcatttaccatgacctacgtggctaatatggtccaaattacccttaagctcccgctttaaggtccataaatgctcctaaggaaaaatccaccgcggcgcgctcagtcctctcttgctgaggcgccccgctgcactctkctgcagcgttctttctgtctaataaaactttcctttttcaaacctatactgttgtcggtaaattctttttaccaacccacgagtcgaccacttcccgatgccggggctctgacacctcgcctggca

SEQ ID NO: 238 - DNA, 140 bp, Homo sapiens
  repeat_region (1)..(140): mer85
cccatttatgcctgaggttgcaattttttgaatttttgcatgagtgaaaaatcagaccttggcgatgaccttgagcagtaggatataaataactcccacatgcttagcgttccaataatggaacactaggcataaatggg

SEQ ID NO: 239 - DNA, 206 bp, Homo sapiens
  repeat_region (1)..(206): mer86
gacttccgtttctagtaatatggtagactagatatcctgaaaacccttccgctacaaaacacctagaaatgctggataaaatataacaaacatccttttaaatgcatagctgagctcgcaagaaagtaagggaaatccccaggggccaaaaatgaagagagaactgaaaaccagagcggtgagtamgtgagctgacgctgtggctg

SEQ ID NO: 240 - DNA, 541 bp, Homo sapiens
  repeat_region (1)..(541): mer87
  misc_feature (347)..(347): n is a, c, g or t
  misc_feature (304)..(394): n is a, c, g or t
tgtaacagtggagggagacctagcatgactgactccatcttgcctctgacccccwgsggtawcatcctttaggctaaaagcttctgcttaktcctgcacgtaggccaagctaactatgggaggaatttagtttatagttcaactttaaaaaagatggtaacagtccctttcccaaactaacccccgaggagataaggaaagtatacacacaaataacaatgttatgttaaagatttataggaacattgtgacctgacctaggacaaagaagttttgmcaactcctcggactcttgctggcgcccagatgtctgtggtcatcggtcacctcctaaccccaataccccncttsttccccttcccctagcataaaaagaagcctaagattyatgctnatttgagatggttctttaggacgctagtctgccatcttctcggtttgctggctctccgaataaagtcactttccttgccacaacacctcgtctcttgacttactggctgtcgwgcggtgagcagtaccagctttggattcagttaca

SEQ ID NO: 241 - DNA, 612 bp, Homo sapiens
  repeat_region (1)..(612): ltr36
tgtaaccaagtacccccatttttctaagaaaaagagaatgagttttattatttttttttctyttttctcctttttcccctgttccccacttcctacttagccctttagaaatgcaattataaccttttacctccccttcaccagacactccctacagggcaagttcatctaactatgtgcttagaagctccagagcggaactctctcccaccaggagattgcctcgagagataacagtcratttacaacccaaagtatgcccgctacgaaactctctcccacctggagagttttggccacytttacaacctagttctgcccacgaaggcgccagcagtcaccagctcaaccgcctggtagataaggcaccgaagcaagtcacgtagacccccacctgctgcttcctcccctgcatgccattcatgccaagcccccttttaaaagyscctgctttctgctccaaaagcgaagcggtacccttaaggcaggaagcctgtacttcttccccctaagctagctttggaataaaaagtcactttctttataccagacctcgctcttgttaattggactctgcaagcggtgagcaactgaacctgcgtttcagttaca

SEQ ID NO: 242 - DNA, 426 bp, Homo sapiens
  repeat_region (1)..(426): ltr37a
  misc_feature (173)..(173): n is a, c, g or t
  misc_feature (231)..(231): n is a, c, g or t
  misc_feature (265)..(265): n is a, c, g or t
  misc_feature (159)..(159): n is a, c, g or t
tgtagggaaaaattgtgcttcaatggaaaactatgcattgtctagagcacacccttccgggttatctgattctagctctgtcattgtctttgagctattttacaactctgtaarttgtagataactgatagcaatgcaaaataattcttgtctataganatgcaaataaattntgtccggtrgaggttcaattgacttccttcccccactgtggaaaaagccagttttgcntcyatttgcaaattcatttcaatattcctgattncctataaatgtgtstgttctttgaattctcctttgaaccggttrtaacatcttactggttccctcattaattaatgagttaaataaaatctttaacacgtgttcattttatatytgtatgagagtcatgattttaccttttttgaaaattatcctttaaca

SEQ ID NO: 243 - DNA, 468 bp, Homo sapiens
  repeat_region (1)..(458): ltr37b
  misc_feature (131)..(131): n is a, c, g or t
tgttaaagaaaaattatccmaaacttggaaataaggcaaaaagatgacwgcatgtcctttcaatgtcatactggagcattgtctaataggctcactcaaggattatttaattatctaggggaatgtacctntgttgactttgctatttactatttgattagggcccagatactatgaagttacatgttaacttgtagatttctgtccagtagaaaagataaccycaaaggttatagttttattgccctgtaggatattaaccagttttgtatctaacttagcaatcttattccarcattcttctttactgaatgcctataaatacctagtttctcaaatgctctttgaaccagttttaccatcttactggttccctcattaatgagttaaataaaatctttgacacgtgttcattctatatttgtatgagagtcatgtttttaactttttgaaaattatactttgaca

SEQ ID NO: 244 - DNA, 556 bp, Homo sapiens
  repeat_region (1)..(556): ltr38
tgtaaccgagtatcccagcctcaaaatgcattttaaaacttttttctttttcttttttgctttcagccttgaaacatactttgaaactctttgtttctccctttcccaccaggcacttccgtgaacagtgctcgcttatctaattatgtgcttgcttagaaattccaggggccaattttgaaacaaaccaggcagagagacccagctgcagaatcctcccgcttagggggagttatgaacagttagcccaccactaccgggctgaagtcaggatgatgcaaaccagacctccagacgggcgattactcaagatagccatcggaacaagacatgcagacctccaccctcctgcaccactcccacatatttcccacaccttttccttcttaaaccccttcactcagcccaaaagtctgaaatgtcttctttgaggcatgagcctggccatctcccatctgctagcatttgattaataaagctgctttcctttcaccacacctcgcttctcatgttttgagcttctgagcagcgagcagctggacttgagccagttaca

SEQ ID NO: 245 - DNA, 610 bp, Homo sapiens
  repeat_region (1)..(610): ltr38b
  misc_feature (126)..(126): n is a, c, g or t
  misc_feature (380)..(380): n is a, c, g or t
  misc_feature (410)..(410): n is a, c, g or t
  misc_feature (413)..(413): n is a, c, g or t
  misc_feature (415)..(415): n is a, c, g or t
tgtaaccaggcagcttarcttcaaaatgcattttaaaacttttttttccctttctcttgagtttcaagatataaccttgaagcaaactgcagaagccttttctcttatccttaaaatagactccanatccctccctttctcaccgtatatactcccttcacatttatctaactgtatgctagtatctaattatgtgcttacttagaagttccaggggctaatcttgagacagacagaccaagcctggagacccagctgcaaaattccagagattacytcaaggcagctagtcaacaaccyrgccattgttgagatgaygccagcccacastccaggtggactgggacccaagatagccaccggaaaaagacacacagacnttgtactcagcacaattcttgcmagcacantkngnaatgcctyccwtatcaagttttccctttttaaacccttgccttcyccctaaaarttgaagyggttgctttggataggaatcyggccrcttccccattactagttttggttaataaagtcactttctttctacyagacctcactcttgtcaattggactctgyaagcagyragcagccdgacccatgtcakttaca

SEQ ID NO: 246 - DNA, 794 bp, Homo sapiens
  repeat_region (1)..(794): ltr39
  misc_feature (36)..(36): n is a, c, g or t
tgagacggagcagggaccccctcttaggggcctgcngggcactccccccccaagcatggaaataaaggaaaatcttgagttccttcaagggaaattccaggcacctagctagccctgagaagtaaatgagcaacttgataagcaagaaggtaatagtagcttaaaacaatagccaaggaagttagagtcacgrgatgtttggttcccctatagaaactaaagataacatcttaacatatgtccctgagttgtttttcagaaacccggacccccaccaaatggaaaatgccatccgctggcacgtagacctcagataagggggaactgaggactgaactctgaccaccgttctttgttctaaatttcttcctgaggggcctggaggaagtcacgcccacgagccagagctaacattcttttctgctgaccccaaatttttagacaaagcttcgcttccttaaccaatcgcaaatcagaaaatctttgaatcyacctatgacctgtaagcccccgcttcaagatatcccgccyttttaggccaaaaccaatgtrtaacctccatgtattgatttacgattttgcctgtaacttctgctttcctgaaatttacccctgcctttaaaaacccttacctgtaagccatcggggaggtcgggtcttaagcgtkagctgcccgattctccttgcttggcgccctgcaaataaacgccttmctttctcccgctgcaaaatctcggtgtsgatgtttggttttactgcgccgggcgagcggaccccagttcggttcggtaaca

SEQ ID NO: 247 - DNA, 588 bp, Homo sapiens
  repeat_region (1)..(588): ltr4
gaagcaggaaatataaaaggaaaaacaagtaaagggaaaacaagtcctttcctgaccagtctgactcactccaaagtcctgctggagctatgataattatctgcaaggccaggcaggggctccgaaggagggctccaggagcagggatgagaaaaacaagttctccttatcagtttccctgtttgaaattctctccccataacattattctttgttctgctctcacaactatttttgtaactatttctgcaagtctgtaaagattttgtaagttcttgtttttctttctgtagcatggcaaggtcacaagacatgtttaagtaaggtaggctcatgttgcaaatcctgttgtaaaacctgtcacggtatgattaactgcctttgttctgcttctgtaagactgctttctcacctcgcaggttttgcgccaaaaacccgacttgcccctgcctgatgcatgtataaaagtcaagcccgtctttgttccgggctcagcctttggatgttaatccgctgggccagtggccacctaaataaaaccttcctgttgcacccagtgatctctccggcctcctgatacccacaaca

SEQ ID NO: 248 - DNA, 519 bp, Homo sapiens
  repeat_region (1)..(519): ltr40a
  misc_feature (176)..(176): n is a, c, g or t
  misc_feature (243)..(243): n is a, c, g or t
  misc_feature (299)..(299): n is a, c, g or t
  misc_feature (301)..(301): n is a, c, g or t
  misc_feature (343)..(343): n is a, c, g or t
tgttgggagacaattctccatgggtctctcgcatttctgcacgtcttgtgagcagaggcactgactgcctttgttctggactatcttttcaaggatgtttgtatagcgaacagccttggaagatagagatagtgtctccctctggagcaaagggcaggtttgcttactagccttgnaarataaagataatgtctccctccggggcaaagggcaggcatgcttactgcccattataaaagattngggtttcctaagctcggggttcctcwsctgtracgcaaacccactgcgtgtgcagnantcatctggsccccttcgcatcgccctcgtgggacttgggggncaaggggaactgacgcaaacatgatgctcatgctgcctgctgtgctgtgartaataaagtcctttgtctctgacccaggagtctcgtgtcttctgccagcatccatgaaactgtggcaggctaacttgttagcttgcaagtagggtaaaatctcagacccttcacagttcttgaca

SEQ ID NO: 249 - DNA, 462 bp, Homo sapiens
  repeat_region (1)..(462): ltr40b
tgttgggagacaattctccatgggtctctcgcgtttctgcacgtcttgcgagcagagcactgactgcctttttttctggactatcttttcaaggatgtttgtatagcgaacaaccttggaagatagagataatgtctccctctggagcaaagggcaggcttgcttactgcccattataaaagattcgggttccctaagctcagggttcctctcctgtaacgcaacccactgcgtgcgcagcatccayctgggcctctycgcgtcgcccctgtgggamttggggggcaaggggaactgacgcaaatgctgatgctcwtgctgcctgctgtgctgtgagtaataaagtcctttgtctctgacccaggagtctcatgtcttctgccagcatccatgaaactgtggcaggctaacttgttagcttgcaagtagggtaaaatctcagacccttcacagttcttgaca

SEQ ID NO: 250 - DNA, 773 bp, Homo sapiens
  repeat_region (1)..(773): ltr41
  misc_feature (189)..(189): n is a, c, g or t
  misc_feature (332)..(332): n is a, c, g or t
  misc_feature (378)..(378): n is a, c, g or t
  misc_feature (399)..(399): n is a, c, g or t
  misc_feature (446)..(446): n is a, c, g or t
  misc_feature (456)..(456): n is a, c, g or t
tgtgccagttatcaatttattgcctctcagctccaaattcacccttattgcctgctctgtgaaaatggatctggaccctttaaatatttttcctttgccagctggcatgatgttaagctttgtcagtagagggcactggagagacattgcaggaggaaggggcttttcttcctggttcctgtgtgctgntgtgctwggcatgctcacttggcaggttcctgtagctcaggcytacagcttctccagtgcccagttcctgcagcgcacacagcttctctagcacccggttcctgcagcatgtgcmccttctcaagcatgcagctctggcagtntaatcagcagtgtccagcagcttcccccagcacccatcactcaggnggtttcacagtggggtgcctntggtgagatacctccctgtgaacagctttccctgacaccctagaggntggatttccnagaagttccacagggtrgatttccagcaagttctgttagtgcagtaccacagtaacttctctgccatccagtaagccatagctgtgcctttgtccaacaagatctggatctcagccctggggggaaggttctctcctgggtgctctrtctcagccctaggggtagtggctgctccttatatctgctattcctatattctttagagttctctttacctcttastagttaattccctgttatagttaatatttatattaaacttttcctgttcaaattactgtgtggtttctstctcctgattggacccagacatatag

SEQ ID NO: 251 - DNA, 495 bp, Homo sapiens
  repeat_region (1)..(495): ltr42
  misc_feature (16)..(16): n is a, c, g or t
  misc_feature (58)..(58): n is a, c, g or t
  misc_feature (414)..(414): n is a, c, g or t
tgtagggtcccccagnctttcccctcctttctttctctgtcctgaccgaaaaacagantgccttgaccactctgtgacccagccagctgcaggtttttccctgcaggcttgaacccaagccagggccttgaacattcccaggcactgataaaggtatttaggttgttgcccaaaacactgaaagaaactagccccggccctgagccaaattccttaaaccctcatataaactccataccctgaccccctcgctgcagacatacctaggtagaacatcccttttctctcactgtccatcttgaggactgctgcagcccactctgtaggtaagttcccctaataaatgctttggactgatcaccctggcatttagtgcttctttctttggaatcccaactggccccatctcagganggtttggggyactcccttgtgggaactcccctgccactgcttttggggcgactccagccacaggttcagcgggatraaaca

SEQ ID NO: 252 - DNA, 602 bp, Homo sapiens
  repeat_region (1)..(602): ltr43
tgaggcaggataggtagtcaaggaagtaaccatgtccttgggacgcagcaaccgtggtgaccatacagtcaacacaataagccccagcattcgcattgtagtcgagctcattcaagcaaagctatcttcagtagggamtttcccctgtagagagcatgcgcattttgattttacctgtcctcaaactgaccctttgctcattataatagtaaaaaacacaacccctgggtggagatttaagatgctaatgagacatgcgatgtatgaacaagcatgtacagctactgcgcatgtgcacccagaggaccacccagaacatgcttactagtaacacctctttcccacctccttatgaataatcatgtaagactcccataaagggagtctcccyagcgccartcwwtgctgtctcatccttatgagcagcccgccctgaattctctctctcagggtgtactgtctattctgcacctaactttcaaaatattctttttcytttgcaataaattrctctatgctgcatctcctttgctgtgtgtctcttgtttaaattcttttaaactaagaagacaagaaccgaggtmtcacaacagccatcaaca

SEQ ID NO: 253 - DNA, 519 bp, Homo sapiens
  repeat_region (1)..(519): ltr44
  misc_feature (223)..(223): n is a, c, g or t
tgataacctacargtcacatttggcaggcttccaaattaacccacctcagggaggtcttgtgattcatggccacatcctgtccctgagtaaagaatcttgtgagttcctcaaattttatcgtgagttcctcaaattgttgacgtactgattaatatgtaacctactgacattgaaaaggacactgatttgtttctgaatcataaagttttgctgatttatttntgaatcataaagttttactgattgttttacatatagacattttagcctgtatgttgcaatctgtagccaatgattataacctctgtattgtaccctccaatraaaaaagacaactccgatatgaggagttcccctcccttctcctaaactttcttataaaagccttccaacttgtaamagacttcggaacacwcccaactttgttggtgtgtcttcccaggtcaatcctcacatttggcttccaataaacctttatcaaattatttctgcctcaacagccttaatttcggtcgaca

SEQ ID NO: 254 - DNA, 525 bp, Homo sapiens
  repeat_region (1)..(525): ltr45
tgtaaccgcgggaccagcccaaactgggcctactctgttgataacaaaatgtcaagttaccttgtaggtataacagagcccaaaactgcaagtcatgtagcccgggcatgtgcaatagaaaaagctttgacctctaacaacacccagaaccaatgattcctcccctcggaaccaagaagaccgggacatgaccggaacctgaatgccggaactctttcagaagcaaaggggtccgttggcccggaagatctggggctaaaatctgcctcaacataccttaccgtaaatggtcaaatttgaagccctccaatcagaccctgccaagccaacattcctaaatcctttcccttgccctctgatcccttaaaacttgccccagaccccaaatcggggagacagatttgagcccacctcctgtctccttgctggccggttttgcaataaagcctttcttttctcaaaagctggtgccatagttattggcttctgtgtgcatcaggcagcaagcccatttgctcgataaca

SEQ ID NO: 255 - DNA, 489 bp, Homo sapiens
  repeat_region (1)..(489): ltr45b
  misc_feature (396)..(397): n is a, c, g or t
  misc_feature (465)..(466): n is a, c, g or t
tgtgtaaccacaccagaccaatctggttcaacttttatgtaacaaagttgtgagttgtttttcagttgccatggacccccaggttgaaggtcatgtaacctgagcatgcccagatgaaccaagygtgcaaccacagggggaacctaagtgctcagaccgaggagtggggactgaattaagaagtggacaccacatggcaggatccaggatccaatcagattgagccctggcatcaccccatggcaggatccaatcagatcatgcctcccagcatcaccctcattgcaagatccaatcagatcacacctcattaccctatgcctataaaacctgccccagaccccagctcagggagacagatttgagcatttcctcctgtctccttgctagtcgacnnacttgcaataaagcttttcttttctcaaaagctggtgccatagtattggcttcgcatcaggcagcagnnagcccattgattgcttrgtaaca

SEQ ID NO: 256 - DNA, 461 bp, Homo sapiens
  repeat_region (1)..(461): ltr46
  misc_feature (116)..(116): n is a, c, g or t
  misc_feature (161)..(161): n is a, c, g or t
  misc_feature (201)..(201): n is a, c, g or t
  misc_feature (208)..(208): n is a, c, g or t
  misc_feature (369)..(369): n is a, c, g or t
tgttagtccaaactgcaccattttgtaagctccctgctattttgcagaccttggtcaaagtgaaacattccatgggggttcrggccgtgagaaacatcctgcctaaccacctgacnacaaggcggacaaaggcccactgaagaaacatccctatcatatcntgctgggcaaagatccaaggaacaccacgatcacatyctnctggaanaagggccagaactgcctcatcataggaacatcttatcaatatcctgccgggcagcaagccatactgcccagacccctcccacccagacctataaattgccccagcctgtaagcagtggtgggctctggcattaagctggtcccccacytyyrcaggttttntgctggatataaaacctgcatttgctgtagagctgccctctctctctctctgtgtctttctttaaccctcaccttcccttcaaaacctaaca

SEQ ID NO: 257 - DNA, 452 bp, Homo sapiens
  repeat_region (1)..(452): ltr47a
tgtggaggctaaagcaactccatcttggatgctaatccaccatgttgacttctgattaaccccagttccgggaatgcctctaagatttccagtttatctattgttccttgtgtaagagcaggtacttactgtaaatcctgcccttaggtcaaaacaaccttgatgttatcatacttaccataaatcctgcccttagcaattgtcctacacattccttctgaagcacgtataccctttccctgtggtatataagccctgggtctggggggtaacggcgcggggatccaccatcttgtctcgccgccgcccaagacacagacgtggcttctgtttgtaagtccctattaaatgtttctttctgagaaactggatttgtcagcctctttcttcggcctctcagcttccttggacttttgggggtaggtttgcatagacctgctcaccgcggaaca

SEQ ID NO: 258 - DNA, 443 bp, Homo sapiens
  repeat_region (1)..(443): ltr47b
tgtggaggctaaagtaactccatcttggaagctaatccgccatgttgacttctgattaaccccggttccaggaatgcctctaagatttccactttatctattgttccttgtgtaagaacatgtacttaccgtaaatcctgcctttagatcaaatcaaccttgataatctcatacttaccgtaaaccctgcccttagcaaatgtcctacacattctctctggagcatgtataccctttccctatggtatataatccctgggtctggggggtaacggtgtggagatctacctgtcttgcggccacccaagaccacgcttctgtccgtaagttccccaataaatcaccctttactgacaaactggatttgtctgcctcgttctttggtttctcggctccttctgcgtttgggggtcattttgcatatacggccctttcacgaaaca

SEQ ID NO: 259 - DNA, 787 bp, Homo sapiens
  repeat_region (1)..(787): ltr48
  misc_feature (91)..(91): n is a, c, g or t
  misc_feature (107)..(107): n is a, c, g or t
  misc_feature (172)..(172): n is a, c, g or t
  misc_feature (244)..(244): n is a, c, g or t
  misc_feature (476)..(476): n is a, c, g or t
  misc_feature (652)..(652): n is a, c, g or t
  misc_feature (779)..(779): n is a, c, g or t
tgttggggctcagaaaataccccaaagtatggtgctttggcatgctgagtactttgaactaaaggaaattggaaggccttagaagcagccntcagaaccaaggtctntctctgaccttctcttgcctccctgtctctctgcccctctttctttccccaagcacagggagggnctctctctgaaatttccttatctgactaaggaaacttctttccaaaagaaatgcaattgtcttgaatccccntccctaggaatctcatcaaataaccaggaaagattaaccacatgagaagagaagagactaaaagtcatcaaacccasaacaccacacccagacagacttttcatcatctattcttctgagggcagctctaagagattacctgagagactttttatctgcataataagacaacctttgttcacagtgcagttctgcccctcaccttcctataatttgttctccaccacctccnccagagcccagagaaactttgtcccaggccattggtctgttctttgggcccattcatttcccctaaaaatcatttactacccctctaaaattgcctacatcccccccatttccctctcccctatgaagagggtatttaagcttcaaccatctggcccttctttgagtctcatatanattttgtatgactcccatgttcatatgcatgttaataaatttgtatgccttttctcctgttaatctgtctattgtcagttcatttcagcaaaccttcagaggggacagaggggaagctttcctttcncccctaca

SEQ ID NO: 260 - DNA, 676 bp, Homo sapiens
  repeat_region (1)..(676): ltr48b
  misc_feature (96)..(97): n is a, c, g or t
  misc_feature (263)..(263): n is a, c, g or t
tggggctcagaaaataataccccaaaatatggcactttgacatgctgaactgaagaagcagcctcaaggtctctctgacctcccccccccctcccnnctcccgtctctcaatcctctgtctctcccaaagcacaggatgaagctgttctctgaagttcccttatctacctagaaactggacctgccaaagaagaacacaattgccttcaatcccttccctgaaatttcattaactagagaagattaaaactcatatcacaganaaaaaaagactgaaaattaaacaccacacctagagcccagacaaactttgtcacaaaccattgtctgttctctggtcccattcaatttccaaagagaattatttacaagcyattgtctgttctctgggcccattcatttcccccctaaaaatcatttactacccctcaaaaaattggcctacaawtttgcctacatttcccccatctccccttcccctatgaagaagggtatataagcatctgtaccccattgggttattgggtaatcattctcctctgtgattcccccatgctatgcacgttaaaataaatttgtatgcccttttctcctattaatctgccttttgtcagttgattttcagtgaaccttcagagggcaaaggggaagttttcccttggcccctacaagggca

SEQ ID NO: 261 - DNA, 595 bp, Homo sapiens
  repeat_region (1)..(595): ltr49
tgaaggaaatcaaaatatttyaccccaaaatatayttctttgacatattttgagatggctrttcagagggcctgcaaacagaagtagccctgcaaagctgtcttttgtgggggagatttgcatctgtagagaaaatctgcattgatgcagccaggctttctctgaggccctcccttgtctggatctaggaaagattaactgagagtctgacacctttaaaggtctgaaagaaacatttaccatctattctctctgagggctgctacctgtgaggtttcatctacataacaagaccacctttgctagccaggcctcctcttctctccctcccataacctgtcttgccactataacctgatttaccaccataacctgttttgggccatgctccgagcccccattctttctgtaacctcaagatggtatataagcttctgtaccccattggggggagttttgggtattcactstgattctcccgtgtrtrcacgttaataaatttgtatgccttttctcctattaatctgccttttgtcagttgatttttcagcgaaccttcagagggcgaaggggaagttttcccttggcccctaca

SEQ ID NO: 262 - DNA, 969 bp, Homo sapiens
  rerpeat_region (1)..(969): ltr5
tgtggggaaaagcaacagaggtcagattgttactgtgtctgtatagaaagaagtagacataggagactccattttgttctgtactaagaaaaattattctgccttgagatgctgttaatctatgaccttacccccaaccccgtgctctctgaaacatgtgctgtgtcaaactcagggttaaatggattaagggcggtgcaagatgtgctttgttaaacagatgcttgaaggcagcatgctcattaagagtcatcaccactccctaatctcaagtacccagggacacaaaaactgcggaaggctgcaggggcctctgcctaggaaagccaggtattgtccaaggtttctccccatgtgagagtctgaaatatggcctcgtgggaagggaaagacctgaccgtcccccagcccgacacccataaagggtctgtgctgaggaggattagtataagaggaaagcatgcctcttgcagttgagacaagaggaaggcatctgtttcccacccatccttgggcaatggaatgtctcggtataaaacccgattgtacgttccacctactgagatagggagaaaccaccttagggctggaggtgggacatgcaggcagcaatactgctttgtaaagcattgagatgtttatgtgtatgcatatctaaaagcacagcatttaatcctttaccttgtctatgatgcaaagacctttgttcacgtgtttgtctgctcaccctctccccactattgtcttgtgaccctgacacatctccctctcagagaaacacccacgaatgatcaataaatactaaggggactcagaggctggtgggatcctccatatgctgaacgttggttccccgggcccccttatttctttctctatactttgtctctgtgtctttttcttttccaagtctctcattgcaccttacgagaaacacccacaggtgtggaggggcaacccaccccttca

SEQ ID NO: 263 - DNA, 795 bp, Homo sapiens
  repeat_region (1)..(795): ltr50
  misc_feature (342)..(342): n is a, c, g or t
tgtgccagttattaagctattgtctctcagctccaaacccacccttctatactctgctctgtgatgctggggctgggactcgactctgcaaaccacatttctgctttgccagctggctctccctgttaggctctgccaatagggggcgctagagggagactgcaaggggctggaggggaggaagaagggacttgctccttcctgtctgctgctgtttcctgtctgcttcctgttcctgtcagcatcaccccagcaatgcttcttcaccctggcagcagttgcttccagttgattccagcagcagcagttgattccagtttgcrsagttccagtttccaacantttytcccaacactcccagaaccagcctcattgtaccccctcctcctcctcagagacaccagcaccagctgggcagtgccccctcctcagaggtctgagtcccagctccatggggcccctcctctgagctcagagacaccagcaccagctaggcagtgccccctcctcagaggtctgagktcccagctccatggggcccctcctctaagcttctaagttttaataattccaacctcttcccttttgttcccccagccctagggggtggtggtagctgcttcctgcagttactacctctgtgataccttagtgttctctttttgccttttcagttctctaatamacaactttatacctagttaacctaagttaacaattctttatattaaattctctctgttaaaataactggtgtggtttctgtcttctcctgactggaccctgactgataca

SEQ ID NO: 264 - DNA, 671 bp, Homo sapiens
  repeat_region (1)..(671): ltr51
  misc_feature (25)..(25): n is a, c, g or t
  misc_feature (191)..(191): n is a, c, g or t
  misc_feature (193)..(193): n is a, c, g or t
  misc_feature (314)..(314): n is a, c, g or t
  misc_feature (378)..(378): n is a, c, g or t
tgtgatctgagagaccaaaatagangcccctttatcaactaagacgggccctaaggttaaggaaacaaaagttacctacgggtcaagggttcagggcctggctggcatggcaaatttctaaattcctacaagaaaaaccacactcttgctaaactccctaacacaataggagctatcaggcaaattatcananccctcctaactctgatttacaacccagaccactacaactctgattggacagaggactggccttacaaacattcttttctgataagaaactgcagaccataagccagttttggccagtttanagaggctgcacacaaactgtctttgtgtcctatagttcaccttttgacgtaaagagccaaattntacttcattttaatgctaaaactccaccccaaagtgaacatgggatgtatgttacatatatgtttacccattgcacatgtgctcggctcccctcataaatatttatagcttttcccccaaacctgctgaatatgtatgtctccattgtgtaataccaaccctgtgaggcataaaacccaacctgccctttccctctttgaagagagagcgcctttggtctatgccagagactatctcttcccagtttgcaaactgatattrccaataaagctctcctttctactatttagcca

SEQ ID NO: 265 - DNA, 421 bp, Homo sapiens
  repeat_region (1)..(421): ltr52
tgtaataaagagtctgactccattttttgatgtttgactgctgacagcttttaagcctcacccctccctcttccctttgccccacatctgggcaagctgataagaaagcccaggtgctccctcctttggtactagcaggaaattcaaaccatacaagcccctgcctgcgggaaccctcaccccagccccacccccctaaccacaataaaaaccccaagccagtctcctttccctgctctctcaagacatttttggacctgcttgggaggcctgccctgctctccccagaaagcctcaattatgtaagtaataaaccttttcataccctcttggtgtgtgtgtggcatcatcagtcttaacatccaaaccaaattttgggtgggggagtccatcctgcctctgcagagtgaccayaacaaca

SEQ ID NO: 266 - DNA, 519 bp, Homo sapiens
  repeat_region (1)..(519): ltr53
  misc_feature (184)..(184): n is a, c, g or t
  misc_feature (359)..(359): n is a, c, g or t
tgtggtgtaaggcctaaaattaaggcccaatattatgtgctgccttgacatctggtgaaatcaggagggcctcaaatggcctaactacaagttcccctccccactctgctcccatggataaggtcccctagccaaacaaccctccttatcaaggggaccaggcacagttcctgcttatccctgntgagtagygggtttcagttccctgccagcccgtggaattattcaaayaagccaatcacatcctcctgcgggaaccaggggtcacctcaccctcttgatactacaaagcctgcctcccacagcccctggttgttcactctgttcctgagtgcaacccccatgtggccctgtgtggnatgtggtgtcctcctcccccaggctgtgagtatatgtgattaataaactgctgtcaatctcatctgtccagtgttgggtgtcatgtgtttarccatccccataaccctagggtgggaatccctccctcaccaatggggtgaagaggaggcaatwaaaaca

SEQ ID NO: 267 - DNA, 510 bp, Homo sapiens
  repeat_region (1)..(510): ltr54
  misc_feature (266)..(266): n is a, c, g or t
  misc_feature (280)..(280): n is a, c, g or t
  misc_feature (288)..(288): n is a, c, g or t
tgttaaataaaatttataggaggccattgttttggactaagctcctgcactaggccccaacagaacagaccaaaccaaaatggagtcactcatgctaaagttccatgtcaccaagctgaaactaagttgtttatctgaccttccaagaaatcaggagagagagagagataacagccaaatccccaaacaggccagttttagccagcatgataaggaagtcccctctgctttaacctttaacctaatgttaagcaatcagttacttntctattgttctgtntccctgtnttaaccttacaaggaaagtaactttgaaatgaccaatctgctttttgttctctgtttctgctttcttcagcccttttctgtctataaagccaacctcctctgctcagctcatyggaacactcattctattttatagaatgaggtrttgcccaattctagaatcacaaataaaagccaattgagatctttaaactaaatttgttgtaattttgtcttttgaca

SEQ ID NO: 268 - DNA, 548 bp, Homo sapiens
  repeat_region (1)..(548): ltr55
tgttatataaatgagccaaagatggcctctgtgtattggcccctaggttgtttatttcttcactgcaggctgagacctgttagctcaaaagcccaccggcaccaaactcaaatttttacacatccawattgttttaaaaatagcccaaacaagcagatttttagccatttagagcctgcctgctttgcataccccgcgaaacytcacccaacatctgctagccattgcacttataagrccccaargcgctgctgcyctttggagctctctgacccagagactcccyaaccgtgctgctgagaaacatcacttagacacataagccccctctccgattcccctctcccccgggagttcccttgccctcctccccttctggatggtggtcccastccctaaacctctrgacagtctcwtgctgtgaggagcttccccttcatgcaaccctgtccaagtgccacccaataaagtttgttgtgtggtactgcccctgcgtggtcatatctttttccttgatcagcccccaaatcccttraacccccttcaca

SEQ ID NO: 269 - DNA, 445 bp, Homo sapiens
  repeat_region (1)..(445): ltr56
tgagaattaagaaaagaacttttatctgaggaatgcaagtcttttaaattatcaggcccagagagacattaaaatgagaccgcaatcacgtcctactccccactttgagctatgtatttcatctcttgaaactgcttgctattgccacaagtagctataaattaacctaataatgccacaccrgacactataacccacaccctatagcttaacaatgtatatggccaatcactaatcaatgttatttctgtaaaccaatgagaattyctgacaaacaactttgtatcagcccactccctgtccccctcttttttgcctttaaaaatccacttgtaactgctgctaattggagtgtatattcagggcaacttgaatctatgctcctgggttgcaatcctcaagctttggctcaaataaactctctacttatattaattttgcctca

SEQ ID NO: 270 - DNA, 411 bp, Homo sapiens
  repeat_region (1)..(411): ltr57
tgtagtgtgacaggtcccccaaccaggttacttaagggtgtatgtccgctgcctgaaccctgaaggccaggtggtgagccaaggccatggtgcccagctgaggagcaggtgtccctgagaacccaaacatcccrgagagtatctgagaacctaccaaggaaaacagtcccattacacacacacagtaggcaaagagccagaaaattagcttaaaagcagcttagagatgggaggtggcacggatctctagagctgtcctgctgccatccaggagtgccctgtatgtaagtcctaataaactcatctacttatcaagctggacttgtccgagtcattctttggtctctcrgctccttcccagtttggggggaggtatttttttatatacagtcccaggtttttcttgtaaca

SEQ ID NO: 271 - DNA, 679 bp, Homo sapiens
  repeat_region (1)..(679): ltr58
  misc_feature (150)..(150): n is a, c, g or t
  misc_feature (225)..(225): n is a, c, g or t
  misc_feature (386)..(386): n is a, c, g or t
tgagacagtatagggaagagactcagtcctggcagacaagagacatggtaaccaagatcccaatgggcctcacatgtccaggcatattccctcccctaccttcttgcctcccttaacaagctgacccaagtcacgtagcagaaagggggncctctcctaacttagctgaccaggctgaattcctaaccataaaaggaagaacctaaccatttatctccttgagtnatgtcttccaaggttgctgaagcaggactctggcattcctgataagaacctgaccagatgcagccggctgaagacaagatggactccagcgctgacctttcaccaagtttttcttcattataatctcattgtaatactaaaatctccgcccarggtgggrnttatctgccahtttctrgacatgcgatgcatgttagagcatgacgtctcactgcgcaggcgctaaaaagaccccgcctaaacatgcttgcctacacgtcgctcctttttcctgcctcaacttccttaaaatgacaagagccgagcccttttgggagctagcatcaggatccctttcctgtacgctgctcccttgcgctgctcgagccgcaagcctattaaaccttgcctgagaaaatcggtttggcctggtgttaatttctacttacatgagagccaaggaacttggggtcca

SEQ ID NO: 272 - DNA, 597 bp, Homo sapiens
  repeat_region (1)..(597): ltr59
  misc_feature (308)..(308): n is a, c, g or t
  misc_feature (312)..(312): n is a, c, g or t
  misc_feature (553)..(553): n is a, c, g or t
tgagaaataaaaataaaattctaagcccccaactgactgaacagaccccctcttggccgagggaaccccagagaaaccttggaagctgarttcacggccataacaggatgggagatcagacacgcctcattataycccctccctcgctaactaccattaggttttcttccctaagggctaaacagaaaccagccctttcaaaagtctccacactgataatgtccattactagcttatcttcccaggtacagaacaaagacaagatgagattaatcattccttcacccctccccgagacatctgcttantttnttcctctattcccttttycttcaaatgttcaccttatcttatgtaaaatgtagatttactgggcactaactaaagtctcacaagtatgtaatcattcgtctcactgccacccccttttttaaggaaaatgtgtaaatactaaacctcctgagaacctctttggaaaaaacagccacagatgcttctgtgacttacatttttcctrgrtgtgccctcaagctggctcagtaaacctcgatgntttgagacttatacctcaatcactcattttggttatcacyctca

SEQ ID NO: 273 - DNA, 586 bp, Homo sapiens
  repeat_region (1)..(586): ltr60
  misc_feature (37)..(37): n is a, c, g or t
  misc_feature (96)..(96): n is a, c, g or t
  misc_feature (121)..(121): n is a, c, g or t
tgttagagtaggcagatagccagacatgagcaggagnggaagcccctgrgaaaaggaaggtctggaaaatctcacacccsagagaccacccaaaanatacataytagatatgagcagagangaggggaaatacctatgcagaaaaaaatgccccttaagatgcccagtaatcattcactctgcagttaaactgtcagaatgttgctagctacatgctgataagggaagagggcaaaggagaaattcctaagagataygcaggtgcagtaagtacagatttgaccactatacaaccttcctggggtggcagtaatgagcaatgcmgccattaggtagrattcatatccaacaccgggtccgtgcatgcgcatcaaccaacagtaagggaggvtcccacaagcctgggtaggaactaggtggggaaargcagggacttaaggcagaagcaggaaaactagasaaagaaaaaggtggagacttaagacagaggtgggaacttcaaraaaaatcygacatcataaaaaccccgtgcagactctcagggctgctgctggctcactctctttcagcagcccrctctgcctca

SEQ ID NO: 274 - DNA, 595 bp, Homo sapiens
  repeat_region (1)..(595): ltr61
  misc_feature (283)..(283): n is a, c, g or t
tgaggcagaaatttaaaaataataataagtactgcattcattcactccaagaaaagtaaaagccaaggcccagaatgtggcaaggcaagggttaaaaagaaaaaaaaaargaacaagttttcctctgcctagccaagctcacttcaaggacagttataagataacgctgtycgaraagccaaggccaaaggaatgggctccagacacccccccacctccagagcaaggttgaaggaaaaaaagagaaagacaaattcctttactgttactcctttccctggcntcttaagcatgactatgttttacaaatgtctgtatttagccagttcttgtttttctttygacgcagctacaaggccaccagctatgcaaggccacaagttatgttatgctatagattatgtgacctgtcactgtatgattaactgcctttgttttgcttttgtaagcctgcttataaaaaccccrctctgtctttgttcaaggctcagctttttggatgtgaatccactgagctggtgcgtaccttaaaataaataacaatcctcctgtattcacccatattggtctctctagtcctcagtttcccrcaaca

SEQ ID NO: 275 - DNA, 719 bp, Homo sapiens
  repeat_region (1)..(719): ltr62
  misc_feature (318)..(318): n is a, c, g or t
  misc_feature (674)..(674): n is a, c, g or t
tgtatagagcacccttgacataagtaactccatcttagaaaaagactccatcttacatttcaaaaggcatcttgccaacagggaccagatgttttgcctaatcaataaagactgcayccaaccagataaggacataaacaagcacactcttccactatcagtcctcaccagaggactctgtggccataaaaagagcaggacttcaccagctcaaaatggccatcttaacagacaccgtcttgctgtcacttgtgataagcacccagcatctgccaccaaaggctctgcccacatcaaagactcttccttgcaagacantgaggctgacggactgcctggatcaggccaggacactctttttgtctacgtcactctccctggactggttcgttaaccctttttcctatcccttttctcttgatgttaaatgttactttgtttgttgtggaatgtttaatctataacatttatatattgattaagtatactattatgtatggtttgcaatattgactgacttgtggagtggcttgagcctgtgtgcccatggctctgactaccgagtgaaygggaagtactaaggagaattgcctccttgggaactccatgtagctcgtggcttttgtgattgaaatagcatcaataaaagtctgacattgtggaaagacacaaanatgtgtggacctggttatctctgaccttgcrctgctcacgacaca

SEQ ID NO: 276 - DNA, 557 bp, Homo sapiens
  repeat_region (1)..(557): ltr64
  misc_feature (339)..(339): n is a, c, g or t
  misc_feature (344)..(344): n is a, c, g or t
  misc_feature (100)..(100): n is a, c, g or t
  misc_feature (468)..(468): n is a, c, g or t
  misc_feature (542)..(542): n is a, c, g or t
gtgagacaaagtaacaaatgtaagaagccatgtctgctcatttctgcttgccaacataatttcacaaagcccctgactctgtgatgacatgcagctctcnagaaagatgctttgaagacaaarcaggatrgagcacacagccccccayrtctcttgcctgagtcactayattccttaaaagataaatgaccctagtccttgccttttcctacacagaagataatgtctgacagggttagtgattatgcctctgtaatctataaccagatgtactcttacacccaaactttgatgtgattctgctctaatgtaacttctgagcaagtttgatgtgattanttctngcaagtttgatgtgattttgcacgtactgaacctctaccacctgtatataagctgtgggctgaaacactgttttggagcagtctgacagaacctctctgaaagactgctcccaggctataggcntycctcagtctacagtcctcagtaagacttctgaataaaactaactttaattctttaaaagcttgatttttttntttctttagttaaca

SEQ ID NO: 277 - DNA, 669 bp, Homo sapiens
  repeat_region (1)..(669): ltr65
  misc_feature (131)..(131): n is a, c, g or t
  misc_feature (465)..(467): n is a, c, g or t
tgagaaagtaaaaatctgccctgccattcatcaggctgggataacagacacagataaagccagctgcaaagtataacaggaaacaatatttctcccaaggacatactgcagctgtaaagtgtcataacaancctccttctttgagtgactactgctttcttactcactgagaaaccttgttctctaaaatcatagactatcagaaactttgctgtttgaaattatatcagtaagaatgaaacatcccactcttgcctggaggatctaagtcactttgacacagagaagcagcctcaatttccaacccaggtgcagagcttcagataaggggtttctggacacaacattccacatttatcttaactttgtagtttccaaggaaacaggaccctgggtccactttgcagtccaggacctgatgttgacccctttacacacagccctgctttgctttgagcctatcannntcaaaacactgcttcatttaaatttcacctaaactccacccttcccccaaatcctataataactctatcttttcctttgtttggtgagatgctccatggttcctctggtgtgcagtctccctcattgcaataagtcaataaacctgactttgttggactacaggtttgtccctggtggtcttaggctgattgggctaggaca

SEQ ID NO: 278 - DNA, 610 bp, Homo sapiens
  repeat_region (1)..(610): ltr66
tgttctgtgcgggaaacgcgtgaggggagaagaaaagacacacacacaatacctttaagggtaaacaagctttatcccacgtaaatggcaatgcagatataataagcaaatgatataataagcaaattgatataataagcaaattgcaatgggaaggggagaagggaaaagatatatatatatgtatatatatatatatatatatatttacactcaccagactatggaggattcaccaccagactgggaagcaacagcctgggctccagagtcggccactcatccgtgcacagacgaggagaggtctcatgaagcttyggygcagtctgggaccctagctctttttgtaacgagttgtttggcatgaggcccagtcacgagggcccttcacgactgggctcaaggaacacaaaaaggtcaacttgtttttgtgattgtctattgtttttcaataactaatgtataggaatagattgaaatagagatttctccgaaacagcgctggatgaatgcctcaaggggctcacacaacctgttccaggacttggtgaccattgtttgtgtccatgttcaattgagttcaaatttaatatttaacttttcctccaca

SEQ ID NO: 279 - DNA, 566 bp, Homo sapiens
  repeat_region (1)..(566): ltr67
  misc_feature (16)..(16): n is a, c, g or t
  misc_feature (98)..(98): n is a, c, g or t
  misc_feature (235)..(236): n is a, c, g or t
  misc_feature (402)..(402): n is a, c, g or t
tgtcattyttttggcnactcagcatttgaacacccttcctatgtttggggaatttcccaccttataaattctacctctttaaggtagaagccagaaanctcattttcccagcctcccttgcagctagggtgcwggcatgtgacctaggctccgccaatcagatgcacccatgcagcaagacttcaaattagaagctagtgatgcaaagaagcaggtgccatgcagaatccactcnngggtgagagtggcagcagctggcagagagttttcagaggcaggagtggcagagatccaagtagtagtgtccagtgttcatgtgtggtgcaagtggtggtatgcagtgtccagtagtagcagcagtggtatcctcactgtgaccagttctgcagtgtgatttgggcngcattgttcctggctgtatagcctctaagcctggttctctagccctcctagagattctgtgagctacctaatatcctttaatattcctttaataaattccttttctgcttaaattagccagagttggtttctgttgtttgcaactaagaaccctgactgataca

SEQ ID NO: 280 - DNA, 563 bp, Homo sapiens
  repeat_region (1)..(563): ltr6a
tgtgataccttaccttgttttaatatgacacagactctcccttagctgagaaagccagacagactccatttggctccttcatttgcaagacatcaagggctccttacccacccccttcctcaaggactcgtgcaagctgactcccagcacatcaaggtagtgcaattaaccaataaggtactgtggcaagttatgtccacagttcccagaaattcgcccaagtgatagtaccctaagcccccgcgtttgtgtctggtagatagcagccaaagccctcgcacctatcaccttgtgatgtgatggatttaaagcccctgcacctggaactgtttgttttcctgtaaccatttgtctttttaactttttttgcctgttttacttctgtaagattgctacagctaggcttcccctcccctctctaaaccaaagtataaaagaaaatctagccccttcggggccgagagaattttgagggctagccatctctcggtcgacagctaataaaggactcctgaattaatctcaaagtgtagcgtttctccataactcgcttggttacaaca

SEQ ID NO: 281 - DNA, 450 bp, Homo sapiens
  repeat_region (1)..(450): ltr7
tgtcaggcctctgagcccaagctaagccatcacatcccctgtgactagcacatatacgctcagatggcctgaagtaactgaagaatcacaaagaagtgaaaatgccctgccccaccttaactgatgacattccaccacaaaagaagtgaaaatggccggtccttgccttaagtgatgacattaccttgtaagagtccttttcctggctcatcctagctcaaaaatctcccctactgagcaccctgcgacccccactcctacccgccaaagaacaacccccctttgactgtaattgtcctttacctacccaaatcctataaaacagccccacccctatctccctttgctgactctcttttcggactcagcccgcctgcacccaggtgattaaaagctttattgctcacacaaagcctgtttggtggtctcttcacacggacgcgcatgaaa

SEQ ID NO: 282 - DNA, 691 bp, Homo sapiens
  repeat_region (1)..(691): ltr8
  misc_feature (502)..(502): n is a, c, g or t
tgaaaccgcctttgcaaaattatgactgagacagtgaaagagatctaacttwactgactccatcttgcttctaacctccaagctgtccttgttcattcctgggcgtaggctgaactaactttgggagaaacttagtttatagtttatagtttaaacaaagacggtaacagccctttcccaaagcagacctccttcttgcctggggactagattgcctttgtaggactaacattagccgcaagattagaaattatggtttaggagtcatgcagctggaggctacaagattctgaccctccctaaactgctcctaagatcagtgcttgagatattttgcagaccctgcgcttgatggatcagctggcaccacccagatcaataaactggctcatctgatcttgtggcccccacccaggaactgactcagcgcaagaagacagctycaactycctatgatttcatcyctgaccaatcagcactcctggctcactggcttcccccnacccaccaagttatccttaaaaactctgmtccctgaatgctcagggagactgatttgagtaataataaaactccggtctcccgcacagccggctctgcgtgaattactctttctctattgcaattcccctgtcttgatgaatcggctctgtctaggcagcgggcaaggtgaacccmttgggtggttaca

SEQ ID NO: 283 - DNA, 727 bp, Homo sapiens
  repeat_region (1)..(727): ltr8a
tgaaactgcctttgcaaaaattataacagtgagaaaattatgacagtgaaagagatctgatctaaccaacccccatcttgcctttaacctccaaactgcccttaatyattcctgggcttgggccaagctaactttgggagacatttagtttatagtttaaatgataatagcccttccccaaaactmaaccgcctttgtaaagctaatgaaagaccaccaggytaggaggatgagaggagcctgaattctgctaaggtgtagacataaacgattaccagccattattccagaggtcacaagatttgcaacttccccaattactcctgcagataacatcactattgtagaacctaagattggccttttgagatatcttttcaggtttttttgcatttctgacaccaatggctccacctggacccgccaaccactcctgtggccccacccagaagtgactcagcacgcacgaggaccattttccacacccctatgattgcatccccaaccaatcagcagcaagcacccattgcctagccacccccaccccctgccyaccaaactatctttgaaaaaccctagcctctaaattttcagggagattgatttgagtaataattctgtctcccacatggcgtggccagccttacgtcaattaaactctttctttattgcaatgccatggtctttgtctgtgcagcgggcaggaagaacccatcgggcggttaca

SEQ ID NO: 284 - DNA, 645 bp, Homo sapiens
  repeat_region (1)..(645): ltr9
  misc_feature (230)..(230): n is a, c, g or t
  misc_feature (235)..(235): n is a, c, g or t
  misc_feature (396)..(396): n is a, c, g or t
  misc_feature (399)..(399): n is a, c, g or t
  misc_feature (449)..(449): n is a, c, g or t
  misc_feature (469)..(469): n is a, c, g or t
  misc_feature (484)..(484): n is a, c, g or t
  misc_feature (497)..(498): n is a, c, g or t
  misc_feature (636)..(636): n is a, c, g or t
tgatacaggagttaaaaagaaattatttaggcagatagtgagggtaagggagtcctcggtaaggttttccttttaacgaaaagcagcccccaaatcattttcttttctaacaaagagcagcctgtaaaatcgagctgcagacatagayaagcaagctggaagcttgcacgggtgaatgccggcagctgtgccaataggaaarggctacctgggggcyaggcatgttcaanatggnggctccatcttcccttctctttgtcagccacgtgtacagtaaggagcagacaacatggcgccggccargtagagagcccatttgcataataaaagattagggtggggcggccagccttccccgcgcgctatgyaaacgkcacacctggtccaaccaatctntgngccctatgtaaatcagacaccgcctcctcaagcycgtctataaaatccgntgcatytgccaccagccggncttttccactcgggnacccctctctctnnagagagagagagctgttctcctttctcttttcttttgcctattaaacctccgctcctaaactcactccttgtgtgtccgcgtccttratttycttggcgtgagacgacgaacctcgggtatttaccccagacaacgangccgcttca

SEQ ID NO: 285 - DNA, 644 bp, Homo sapiens
  repeat_region (1)..(644): ltr9b
  misc_feature (78)..(78): n is a, c, g or t
  misc_feature (144)..(144): n is a, c, g or t
  misc_feature (430)..(430): n is a, c, g or t
  misc_feature (443)..(443): n is a, c, g or t
tgttgtaggagttattaagaaattattttaggcagatagagaggaaaaggggtccttgggaagttttcgtttcttttnaaagcagctccagaaacatttcttgtctagcagaaaagccccggctcttagagccaggccggcaanctttgatatgcaaatgcaggccattagaaactgggtccacccaacatggcgattcccaccgtcgtcttcttgcccttgccccacatgtgcctggcaacatggccgcccccacatatccccacgtgtgtagaacatcatggcgccctgcatttgcatattaaaaggctagggtgggagggccagttttttcgcgggctacgtgaatgacatgcctggtcaaaccaatcccctgagccctatgcaaatcagacaccgcctcctccagcctcctcatataactggctgntwtccgccgcacncggggtttcctctctcggctttggagcccccctccctctgtctctgtacaggggagcttcttccttctttcttctcccttctttcttgcctattaaactctccgctccttaaaaccactccacgtgtgtccgtgtcgttttatctaaatcggcgcgaggaccaaggaccctggtgttcctccastcatcggagccgtatca

SEQ ID NO: 286 - DNA, 80 bp, Homo sapiens
  repeat_region (1)..(80): madel
ttaggttggtgcaaaagtaattgcggtttttgccattactttyaatggcaaaaaccgcaattacttttgcaccaacctaa

SEQ ID NO: 287 - DNA, 471 bp, Homo sapiens
  repeat_region (1)..(471): marna
  misc_feature (22)..(22): n is a, c, g or t
  misc_feature (25)..(25): n is a, c, g or t
  misc_feature (70)..(70): n is a, c, g or t
  misc_feature (302)..(302): n is a, c, g or t
ttatacatccaaatgaatgttntcnttcaaagtagtcaccttgggaaagctatacatttatttttaaccnawcacaattctgccattgatcaaaacatttttggaacttctcttttggaattgccttcagaaccagtttatgagccacataagaaaatcagtctcattactttatagtcacacctcatttttgaccaaaaatagtattacccagtttgatcacccaccttattcaccagacttggctctgaatgacttttggctgtttccaaaaatcaaatccaccctcaaaggataaaganaagatttgccaccattgaggatattcaaaagaatatgctgcaggctctgaaggcaattccaaaaagaatgttccaaaaatgttttgagcaatggcagcatcattggaataagtgcatagcttcccaaggtaattattttgaaggggacaactctcatttggatgtataa

SEQ ID NO: 288 - DNA, 1264 bp, Homo sapiens
  repeat_region (1)..(1264): mer100
  misc_feature (137)..(137): n is a, c, g or t
  misc_feature (289)..(289): n is a, c, g or t
  misc_feature (495)..(495): n is a, c, g or t
  misc_feature (546)..(546): n is a, c, g or t
  misc_feature (1165)..(1165): n is a, c, g or t
  misc_feature (1190)..(1190): n is a, c, g or t
  misc_feature (1241)..(1241): n is a, c, g or t
  misc_feature (1238)..(1238): n is a, c, g or t
gattccagggtaakcttacaagacataaattcattcactgcatcattcataggcaagctaytrcaacaaagatgttgaarccagaggtacamaaaaggctgcatgacgttactaatgttaatgttataaaaacaaanctttaatatcttgtacagtagaatctatataatactttgtaataaawtgggaartgaccatgaaaatcttttgtaccacacagaagtttgctagttatcttgtggcaaagtacttaattaagagttgtcaaacttaaagatgagttatattnatttttctttttacaaaaagacaagtgttccaaatttgactgaccttttctgtgatgacaagtgactgtcagtagtatgctacctagtagatatttttgaaaaaaataaacgcacttaatctgtcccttcaaggtaaaggtgtcgatattttaacaatgagtgagaaagtaactgcttttgaargaaatgcacaatatggagagancattttgaaaatagatgtttggaaatgtttccattgttatatgattttgtngccgaaaatgatgtaagtgtgatacctataaaaactctcatatctgcacactttaaaacttggaaacagaaatttctaacctgctttttaaaaatcttccaaatgaagagttttaagtgggttttgaacacatttgttaaaaatattaaaatgcaacatcttccgattagtttgcaagaacaactgattgacatcagggaaaatggaaatttactagccaaatttcaacaaaaacctttgcataattggtagatgggattgaaaaatgagtatcatgatttagtaagcacagccaatgatatayttcttccatttggatctacatatctttgtgaggtatctttttcagctatgacagccattaaaaccaagtattgaaataaagtaaaaaccagaccttcaaatcactgtatcaaagtgttaaaccaagatttcatattatyctagcatttaaataatgtyagatttttaaaaaaaagcatattcaatcatattctctcattaaaaaatwaataataaaattttaatgaatatataaaargttttatatacaattataaaatwtaaattattttaaawtatatttyatctttatctcatccttttaaaatttsttttntgtatatgctttataatatgcatantaagagtagtacatgcatataatttawaaattaaaatacayatgttknaantayatgttcaaaatatttttatt

SEQ ID NO: 289 - DNA, 474 bp, Homo sapiens
  repeat_region (1)..(474): mer101
tgtgaacaaatgtgaacctgaaagagccaatccttcaagatggatcccgagtggctaactgggcctaaatttaaaatagagccaagcggccatttgctgactagaggtcacacacgtactctgagttccccgaaaacccacacctctgtttaactttgggactttcagagctcacctgaaccaaccaatcagagctcacctgcmtcaaccaatcagggctcagctgtatcaaccaatcagaactcagctgtgtcaaccaatcagaactaagcaagtttgaatccttcatttgcataaacggacctgattgggaacctgggcaggaacttttgctataaaacccaaaccctccctttgttctctggaaccgcaccttcgttttacaccgaaggctgcatctccccggtttgcaaactgttcactggaataaagtctctttcctccaaattccttttcagagaacttttgttcaca

SEQ ID NO: 290 - DNA, 570 bp, Homo sapiens
  repeat_region (1)..(570): mer101b
  misc_feature (142)..(142): n is a, c, g or t
  misc_feature (209)..(209): n is a, c, g or t
  misc_feature (353)..(354): n is a, c, g or t
  misc_feature (449)..(449): n is a, c, g or t
  misc_feature (552)..(552): n is a, c, g or t
tgttaaagtatgcccctagctgacagacaaaatggactccctgtggctaamtgaggtgctcaaagttaaaacagaaccaggcagccatggctgggtgagggagcagtcacatattctgtgttctcagaaagatgtaaaagtntcacaggacctccctttctacaatcaagccaaaccagttcctattgtyagtgccaagataaactgcngccagaaaccacctccccacaagcccactagaaacaaacatctgacagagacttctgatttggggcttggaaaccaaccaatcagagctcacctaccccagccaatcagggctcagctgtatcgaycaatcagaactyagctgnnccaaccaatcagaactaagcaagtttcaatccttcatttgcataaatgracctgattgggaacctgggcaggaagttttgctataaaacccaaancttcctttgttctccggaaagcaccttcattttacactraaggctgtgtctccctggtttgcaaactgttcactggaataaactctcctccaaattccttttnagagaacttttgttcaca

SEQ ID NO: 291 - DNA, 332 bp, Homo sapiens
  repeat_region (1)..(332): mer102
gggttgcaaactcaaatgcctacaggggccaggcaggtaacataaatgagtgaagtgggccaggtggggactgtggcaaactggagagcacatgccctgtctaaagggggcagcagctgctactcagctccagccaattgttgccatgtgggaatgtaggcccagtgttgccagatcttctgatttttcaagagaagccagaaatctagatttttatgtgaaatctcctgatttttaaatgttggcaactaatttaaaatttttawaaaacactgtgtaggccaaacaaaacatatctgtgggccagatttagcccatrggctgccagtttg

SEQ ID NO: 292 - DNA, 166 bp, Homo sapiens
  repeat_region (1)..(166): mer103
agttccatggtcaaataagtttgggaaatgctgggttaaacaaagttaaacaggtttctttactgcaggacttctcagagcctttaatatgctaatgtgcattgtgaatctccaagaggggaaatatagtatgcagtrtttcccaaatttatttgaccatggaact

SEQ ID NO: 293 - DNA, 185 bp, Homo sapiens
  repeat_region (1)..(185): mer104
taccatatttcattgaatctaagatgccatcaattgtaagatgcaccattattttatgtaccactaagaaagaaaaaaatgctgccaattaaactataacatgccattaattgtaagatgcatcccaatttcagagatgttaaaatgtgaaaaaatgtgcatcttagaatcgatgaaatatggta

SEQ ID NO: 294 - DNA, 204 bp, Homo sapiens
  repeat_region (1)..(204): mer105
cagcctttctcaactagggttctatgagagaattaagccctaatgccctaaggcatccattgtatgtaatgaattaacttctctcctatgcatcctagaatggtactagttatataccatccttgggagaattgagaaaatagtcactcaaatcattttctgtgttctgtggttcagatgaggaaccctggttgagaaaggctg

SEQ ID NO: 295 - DNA, 258 bp, Homo sapiens
  repeat_region (1)..(258): mer106
cctatttacattaggccatgcattctcaacaggggcaatattgcccccaagggggtgaaaattggttcttggggggagaaaaaatcttagatattacaatggtttgtggccctccaaagggccacagtacataaacagatatacagtatatctgtggtattaaaatttcatggggaagggggtattaggaaaaaaatgtctaaaaaggctccttagggggggaataatgaaaaaaggttgagaaacactggtctagag

SEQ ID NO: 296 - DNA, 197 bp, Homo sapiens
  repeat_region (1)..(197): mer107
caggggtgtccaagggagagaatacagtcatgggttcttagtttctgtttctggttgggccagtaaagccccttcctcatccctcttttctacttatcactagagacagaaactaaaaaccatggcttcaggctgctaaaagcctaaaacaaaacaaaacagaacaacaacaaaataaggcgggttggacaagcttg

SEQ ID NO: 297 - DNA, 633 bp, Homo sapiens
  repeat_region (1)..(633): mer108
  misc_feature (2)..(2): n is a, c, g or t
  misc_feature (10)..(10): n is a, c, g or t
  misc_feature (17)..(18): n is a, c, g or t
  misc_feature (20)..(20): n is a, c, g or t
  misc_feature (57)..(57): n is a, c, g or t
  misc_feature (90)..(90): n is a, c, g or t
  misc_feature (113)..(113): n is a, c, g or t
  misc_feature (135)..(135): n is a, c, g or t
  misc_feature (182)..(182): n is a, c, g or t
  misc_feature (184)..(184): n is a, c, g or t
  misc_feature (225)..(225): n is a, c, g or t
  misc_feature (302)..(302): n is a, c, g or t
antacacctngcagttnnmncacagtttcactgtaaattttaaacacaaataaaaantccaartggtcacatagaatgatagaattgaantaactcaagttctgttgtctttntttttacaatcactatgctatngtttaaatacaggaatatgtagtaccacaggggttggagacatgaantnactgtacccgaagtgagcttgaatgrattctaaactattangaacttactctagaaacaaacatatgtagctgagtccacgtgtgttgggggccaactgtataactggaagttctctnaattaacttccatgtagaatacaatgtttattaaaggataagtaataaaaatgtgctaatttgaagtttacatatatattattaaaactcaacagtaactgcagcaattkgtttagaacttagaccaacaaaagattttttttttwgggaggagtattttatcactgacattgtttagaattgctggtgcatggtgataataamaaagcagactgacttttagtcagttttattattgttaattctctacagacaatgcacccccttattgcctgcacctggggcggaccactcccactgccctgcccttggtatgccactggtttcctac

SEQ ID NO: 298 - DNA, 1994 bp, Homo sapiens
  repeat_region (1)..(1994): mer109
  misc_feature (12)..(12): n is a, c, g or t
  misc_feature (18)..(18): n is a, c, g or t
  misc_feature (31)..(32): n is a, c, g or t
  misc_feature (54)..(54): n is a, c, g or t
  misc_feature (68)..(68): n is a, c, g or t
  misc_feature (90)..(90): n is a, c, g or t
  misc_feature (167)..(167): n is a, c, g or t
  misc_feature (184)..(184): n is a, c, g or t
  misc_feature (249)..(249): n is a, c, g or t
  misc_feature (254)..(254): n is a, c, g or t
  misc_feature (262)..(262): n is a, c, g or t
  misc_feature (300)..(300): n is a, c, g or t
  misc_feature (303)..(303): n is a, c, g or t
  misc_feature (385)..(385): n is a, c, g or t
  misc_feature (413)..(413): n is a, c, g or t
  misc_feature (451)..(451): n is a, c, g or t
  misc_feature (471)..(471): n is a, c, g or t
  misc_feature (493)..(493): n is a, c, g or t
  misc_feature (524)..(524): n is a, c, g or t
  misc_feature (533)..(533): n is a, c, g or t
  misc_feature (576)..(576): n is a, c, g or t
  misc_feature (593)..(594): n is a, c, g or t
  misc_feature (602)..(602): n is a, c, g or t
  misc_feature (611)..(611): n is a, c, g or t
  misc_feature (648)..(648): n is a, c, g or t
  misc_feature (656)..(656): n is a, c, g or t
  misc_feature (686)..(686): n is a, c, g or t
  misc_feature (690)..(690): n is a, c, g or t
  misc_feature (852)..(852): n is a, c, g or t
  misc_feature (858)..(858): n is a, c, g or t
  misc_feature (865)..(865): n is a, c, g or t
  misc_feature (872)..(872): n is a, c, g or t
  misc_feature (1066)..(1066): n is a, c, g or t
  misc_feature (1069)..(1069): n is a, c, g or t
  misc_feature (1079)..(1079): n is a, c, g or t
  misc_feature (1231)..(1231): n is a, c, g or t
  misc_feature (1240)..(1240): n is a, c, g or t
  misc_feature (1393)..(1393): n is a, c, g or t
  misc_feature (1468)..(1468): n is a, c, g or t
  misc_feature (1516)..(1516): n is a, c, g or t
  misc_feature (1549)..(1549): n is a, c, g or t
  misc_feature (1562)..(1562): n is a, c, g or t
  misc_feature (1587)..(1587): n is a, c, g or t
  misc_feature (1587)..(1588): n is a, c, g or t
  misc_feature (1632)..(1632): n is a, c, g or t
  misc_feature (1657)..(1657): n is a, c, g or t
  misc_feature (1689)..(1689): n is a, c, g or t
  misc_feature (1832)..(1832): n is a, c, g or t
  misc_feature (1906)..(1906): n is a, c, g or t
  misc_feature (1914)..(1914): n is a, c, g or t
  misc_feature (1966)..(9166): n is a, c, g or t
  misc_feature (1763)..(1763): n is a, c, g or t
aaagactagatntttcanatyagaacttaannttgtccactatatacacagcantgttaaataaaatngcacacacataacaatggttanaatctgaaatatcttctaaatatgaacattttggcctagaacctttcttttctcacttccttctctctgccttcaantcagtggacaagtatangcatgtgtaatgctctagagatggtttaacaaatttatatccaaaagtcatttccagaagacaanccttnctatraantttaacaaaaagtktacaaaaggtgctaattctactangtnctttgtcatacactggcagcctctttaacatctagagactagatgttgcaaaattaggactcatttgtccattatatacacnatatacaaagcaaaacaaaatgcacaanacatacagaacaagagttcctgaaaatgtgcaattatnaacacactggcacadaaccnttcgcacttccttctctcccanctcctctaaaccactgaataagcacagacantaatatacngctcaaagagatggtttaacaattccattyccmaaagacagtntttcctrtgaattttanntaaaagtnacttaaagngtgttattttactacctctacatttaacatacattangcacttcnraacatctagaaagactagatrtttcaaanaagnacttaatttgtccactatatgtacagtagcattgaataaattgcacacatataacaatggttataatttgaaagtgtcttctaaatatgamcattctggcctaaaacccttcccatctccatcaacycagtggacaataatgctcaagttttcagaagacantctttnctatganttttaangcaaaatgtacaaaattattagtttactaactctacttttgtcatacactggcaacctctttaacatctagaaagactagatgttgtaaaattaggacttgtttgtcctttatatacactatatacacagataagtaaaataaaatgcacagacataagagacaatggttaatcttgcctcactgtaaacacantgntggcataganctctttgcacttccttctcctgcctcctcccctgaaccagtgcacaaacacaatgtgtaytactcaagaggtggtttggccattcccccaaagacaacatttcatatgaattttaacaaaaagatatttacaaaatgtattattttactacntctactttnaacatatatcaggcacttcagaacatctagaaagactagatatttcaaaaaaatacttagcattgtcaacgatatatacagtagtgaggaataaaatgcacacaaaacaatggttataatatgaaaatgtcttctaartatgaccagtctggnaaagaaccttcttctcttcattctcacgccttctgctccatgkcctctaacccactgaatgaacgtggtsgtgtntgttgctcctggtgtcacttctagagctcgtctaacaatttcgtttcnaaaagtcatttccagaagacatttrttttctankattttttaaaanaaaaaagggcatttacaagacgtgnnattttctaacttyttwacatatagaagggctagatatagcaaanattttctwttaaaargttggggggnaagttgagagcagctttttcatattatatacncgggccttctataaacggtggccagtaaatcttcccaaagggtggtgggcatytccaatgcgccaaatgtggcntgttattcyaccatttctctcttccmacatcaaggtctggtagaasgaaggccaaccgcccgatggccngctaaccdttctacccgtcstygtccgggactcygctcaccttctaggccgtttaaggcctttgtccrtcattnctggcatngtcaggactaggtamggtctcgdccaactgggacagagcggtcagcccgggncccgsrtytgygcrrctccrwggcmtaa

SEQ ID NO: 299 - DNA, 500 bp, Homo sapiens
  repeat_region (1)..(500): mer110
  misc_feature (352)..(352): n is a, c, g or t
  misc_feature (468)..(468): n is a, c, g or t
tgaaaactgaaaccaacataatttcctgtccctgdgttaaacaatactgggaccaggcatacttttctgttcctatgttaaacaatactgagaccaagcaaaaataacttagctacttgctccaggaaatacytgctcctggaagataagactgtgaaccaactaaaatagcttacttatcaagactaacagcttactcatcaaaactcgtttcaagaccctcgcctcactgtgcccaccaatccaaagctattatgtcataaactctgcccaatcccaaccagttccccgccttgcaagacccaccttaaaatcacccagcccaggccctaaaaccctataaataatcctnccctaatttttccattttgagacactactaagactctgtatctatgtcaaggtgatgttcttccttactgcagtaagtctaataaaaactcagctttgcttgatcaacaggttttnttttctggtggtctttttggggagycgacagt

SEQ ID NO: 300 - DNA, 468 bp, Homo sapiens
  repeat_region (1)..(468): mer110a
tgagaactgaaaccatctaccacccacacagcttactgactgtctacattaacatgactttactattccactgtcttcatcaacataactttactattccaggaaactcttgcccaggaagataaaagttgcaaataactttattgttcatttcaggaacttcctaaaaaacccatcaactcttcaatagaaagcatcaaacgacagtttatccccaagactctttgaaacccttgcctcaaaaccctcaccttgctgtgtctgtgtccaccaatcctaaactattatatcatgatccttacccaatcctaatcaagcccctacattgaaagacctgccttaaatcagactccaaaatctcaataaatatcctgactttgccctccctcctctgagacactactaagactctgtaaggtggtgctcycccttaccacagtaagcaataaactcagctttgtcttatca

SEQ ID NO: 301 - DNA, 270 bp, Homo sapiens
  repeat_region (1)..(270): mer111
  misc_feature (63)..(63): n is a, c, g or t
  misc_feature (68)..(68): n is a, c, g or t
  misc_feature (92)..(92): n is a, c, g or t
  misc_feature (100)..(100): n is a, c, g or t
  misc_feature (105)..(105): n is a, c, g or t
  misc_feature (112)..(112): n is a, c, g or t
  misc_feature (131)..(131): n is a, c, g or t
  misc_feature (207)..(207): n is a, c, g or t
  misc_feature (240)..(241): n is a, c, g or t
  misc_feature (244)..(244): n is a, c, g or t
  misc_feature (269)..(269): n is a, c, g or t
atatatcttcagcattttgtacatgttctttaattttattcttttccttcacaattgagcacncagtnaactgaaatataaaatgagactcngattttgntaaanatttatnattttgaccacatctaatnatttctatctttrtcycaattatattagattatsagacctacgcttctttttactagtatcagcacttttattttnatatttwttttccactcatttttaataaataanngrnaaaatgcaataaaataktcatatant

SEQ ID NO: 302 - DNA, 281 bp, Homo sapiens
  repeat_region (1)..(281): mer112
  misc_feature (64)..(64): n is a, c, g or t
tccagaccagtggctttcaaactttttttgactatgacccacagtaagaaatacattttacatnatgacccagtacacacatacatatatataactgaaacaaaagtttcataaaacaatacttacccttactatatgtaatgcactctgatattttctattctattctattctattttattttttttaaaaaaaaatgctggttataacccactaaattgatttcataacccactaatttttgggtcacracctgcagtttgaaaaacactgctctagaa

SEQ ID NO: 303 - DNA, 519 bp, Homo sapiens
  repeat_region (1)..(519): mer113
  misc_feature (463)..(463): n is a, c, g or t
tttcccaaacttcagtcattttcataccaccttcatgatttttgccatatctatataccacctgtactatttatttacttaatttttctttaaattgactcactttttttatttaaataaatttattttaaaaggaaactttatatcactaccataaatggaaaaccagtatcacttgccataaatagaaggtaaccataaaaataaattacaatgaaaacaaaacaatgttattaaattctagctagatactgttgcctgcctactgcaaggctctgagcctgaggcctgctctctctttgttaaaaagagagattagcaagtgttagagaggtgttaaagacatactaagcaccaaactgagactttctccttgatgtaatcagaaggattgaaagagaattgaaaagggaataactttctcactatgtgattcaatgttatttaatgccatatccatgtnctacctaaaatcatctttaaataccaccagtggtacatatcccacactttgggaaa

SEQ ID NO: 304 - DNA, 648 bp, Homo sapiens
  repeat_region (1)..(648): mer114
  misc_feature (11)..(11): n is a, c, g or t
  misc_feature (567)..(567): n is a, c, g or t
  misc_feature (582)..(582): n is a, c, g or t
  misc_feature (604)..(604): n is a, c, g or t
  misc_feature (612)..(612): n is a, c, g or t
  misc_feature (628)..(628): n is a, c, g or t
  misc_feature (631)..(631): n is a, c, g or t
tgaagttgttnacattttaattgattcttctctawagaccataatatttttaattgagaaaatattctctctataggtgctgaggtacctggtaagctcagagcaaattctactaaatggargatattbtcaattttaattttttttttattgaaatgtgtaaatatttcagcccaaatatttttataggtattatctttttttgtctccattcagaatacctttctttgacaaatatttttacaagacaaaactcatcaaataaattgtctctatttatgattcttttgaatattttaccaaatttagatgctgcaaaattataggccttctcaattttattccattctagtacagaatataaatttatccaattaaaaatagaagctccatcaaaagattcttcccataagttaagatattccaaagtacaattatagaattatagaatttcaaaattaaatcttgtatacacatttgagctctcattatttaatttgttcagttcctcccttgmttttgtaggaataaatttcaatgtctttctgtgtggcaagctttgttttnaataattacaattynctaaaactttaaaaagctgaanttttttgntctctatttattgaanacnttgattaaagatttcca

SEQ ID NO: 305 - DNA, 655 bp, Homo sapiens
  repeat_region (1)..(655): mer115
  misc_feature (25)..(25): n is a, c, g or t
  misc_feature (29)..(29): n is a, c, g or t
  misc_feature (44)..(44): n is a, c, g or t
  misc_feature (149)..(149): n is a, c, g or t
  misc_feature (284)..(284): n is a, c, g or t
  misc_feature (332)..(332): n is a, c, g or t
aaggctccactctggccctcctccngctncatgcccttccccanggggtaaagagtctgtggggccaaggggatatgcccaccygaaayccatgcccccctttctagaccacgctccaggtacctgggactccagaattccctgtccanatagccccgagcctgcttccagggccttcttccytttccctaggtctgtcctccagagggtggaccgtgccaccagtgtgggcacccctaggcctgagagatggccaaggggtagctgtttgtaggggggttagntgtggacagagcttggacatgcgggctggggtgtccacatacatgcanaggaggccccttatggtgtaggatggagcygggggtgggaagagaagggggagtaggccaggggccaggggctggctctcccccaggcaggctgccatgttctggcatggaactccaaggagtctgagaattctaaatttgaacctggccttccaggtcattatgaaggtatatttgtcaaggtaggagaatagaacatattttaatttaacagtttgttagcttgatttataacttttaaatatttagacatatggtatgtgggcctccatttgtactcttgccctaggccctrcaaatgttaggggtgggcctgggttctg

SEQ ID NO: 306 - DNA, 84 bp, Homo sapiens
  repeat_region (1)..(84): mer116
tattaggttgaaccatatgaaattgctaatattcgaccatttttgacctacaaaaatggcaatttcatatggttcaacctaata

SEQ ID NO: 307 - DNA, 197 bp, Homo sapiens
  repeat_region (1)..(197): mer117
  misc_feature (172)..(172): n is a, c, g or t
cagggatggcaaataggtttcatctcatgtgycaactctgatcgattggtagtggctgcctggagtgctgtgttgagaaggattctgaggctgyatctgggctcagtgggaaagagtgctgtgattgattagtgatgtctgccatgggcacaggagggggaagtagcagcanatatgctatgtatttgccatccctg

SEQ ID NO: 308 - DNA, 717 bp, Homo sapiens
  repeat_region (1)..(717): mer118
  misc_feature (427)..(427): n is a, c, g or t
  misc_feature (476)..(476): n is a, c, g or t
  misc_feature (495)..(495): n is a, c, g or t
  misc_feature (550)..(551): n is a, c, g or t
ataaaaataaaactattcacaattctagtattcaatatccatctagttgccaatgtaaagaatcagtatcatacttcatgcatgttacatctagacctacatatatacaaatttaagagtaatatgaattgtttaatattgcaaaatgttcctcagctaccatgtgcaactgttgtgaatactgtgctaatttgtgagtacctctggaaccacaaattggaacatgaagagaagcaagaaaatggacacttagcactactgggaaatgatactttgttaagttatgcaagaatctattgcattcatgctatctgaggagaggaaggatttgacaagttaattaatttgttttcttttctcttacctaagtgcttctgctgctcaaatcctccctacactctaaagcagtgtctatctctgacgtcancagcagcggcacaacccacaaaccttcatggcatttggacacagtcacnccttttgttttgaggacanagggcaagagatgtggagaagcatttccctggggcctgaayagtgttagtcacannagagtagatgtttagggttataggttgtgctgtgccagtactgagtaccagatcccaagtgacagaggtacccatgtgttctttatttaataaatgtatgtgtgtttgtgatatgtggggccctctaaagcatggggcccagggcaggggcccctcttgcctgggt

SEQ ID NO: 309 - DNA, 508 bp, Homo sapiens
  repeat_region (1)..(508): mer119
  misc_feature (377)..(377): n is a, c, g or t
tagagcagaggttcccaaactttctcagttcatagtgcccttagtgtctcagtaattttttcatagtgcccttaggcagtgtctcagtaattttttcatggcacccctaggccaaaagaaatacctaacagttcyatttattaagtagttaggtccaaacaacttaataagtatttatgtcctaacaacttagtagccatttgaaaaaataatacacataaattgaaagaaaaaaaaaaaatatttttatttcattcttaaataaccacaattacttactaatgggatgtgtgtgcctgttgggcactgcacaacttctcaaaccttggaatcagattggacactgccaccctcatttcctgttccacattgattgnttttcacatagtacttgctttttatcacagcaaccactgaaaacccagcttcacaaagatatgatatcatcaaaaggaatgtagcacacatgatctaatgttgaaactgtgaactacctcaagctagtagt

SEQ ID NO: 310 - DNA, 1126 bp, Homo sapiens
  repeat_region (1)..(1126): mer11a
tgttgcgggaagtcagggaccccgaatggagggaccggctggagccryggcagaggaacataaattgtgaagatttcattttaatatggacatttatcagttcccaattaatacttttataatttcttatgcctgtctttactgcaatctctgaacataaattgtgaagatttcattttaatatggacatttatcagttcccaaataatacttttataatttcttatgcctgtctttactttaatctcttaatcctgttatcttcgtaagctgaggatgtacgtcacctcaggaccactgtgataattgtgttaactgtacaaattgattgtaaaacatgtgtgtttgaacaatatgaaatcagtgcaccttgaaaaagaacagaataacagcgattttagggaacaagggaagacaaccataaggtctgactgcctgcagggtcgggcaaaatagagccatatttttcttcttgcagagagcctataaatggacgtgcaagtaggraagatatcgctaaattcttttcctagcaaggaatattaataattaataccctgggaaaggaatgcattcctggggggaggtctataaacggccgctctgggaatgtctgtcttatgcagttgagataaggactgaaatacgccctggtctcctgcagtaccctcaggcttactagggtggggaaaaaaccccgccctggtaaatttgtggtcagactggttctctgctctcgaaccctgttttctgttgtttaagatgtttatcaagacaataygtgcaccgctgaacatagacccttatcagtagttctgattttgcccttgtcctgtttcctcagaagcatgtgatctttgttctcctttttgccctttgaagcatgtgatcttgtgacctactccctgttcttacaccccctccccttttgaaatccttaataaaaacttgctggttttgaggctcaggtgggcatcacggtcctaccgatatgtgatgtcaccccyggaggcccagctgtaaaattcctctctttgtactctttctctttatttctcagccrgccgacacttatggaaaatagaaagaacctacgttgaaatattgggggcaggttcccccgata

SEQ ID NO: 311 - DNA, 1096 bp, Homo sapiens
  repeat_region (1)..(1096): mer11b
  misc_feature (599)..(599): n is a, c, g or t
tgttgcgggaagtcagggaccccaaacggagggaccggctgaagccatggcagaagaacatggattgtgaagatttcatggacatttattagttccccaaattaatacttttataatttcttatgcctgtctttactgcaatctctaaacataaattgtgaagatttcatggacacttatcacttccccaatcaatacccttgtgatttcctatgcctgtctttactttaatctcttaatcctgtcatcttcrtaagcttcatgagctgaggatgtatgtcgcctcaggaccctgtgatrattgcgttaactgcacaaattgtttgtacagcatgtgtgtttgaacaatatgaaatctgggcaccttgaaaaaagaacaggataacagcaattgttcagggaacaagagagataaccttaaactctgactgccggtgagccrggcrgaacagagccatatttctcttctttcaaaagcaaatgggagaaatatcgctgaattctttttctcagcaaggaacatccctgagaaagagaatgcgyacctaggggtaggyctctgaaatggcccccctgggagtggcctgtcttttatggtngaaactgcagggatgaaataarccccagtctcccatagcgctcccaggcttattaggawgaggaaattcccgcctaataaattttggtcagaccggttgtctgctctcaaaaccctgtctcctgataagatgttatcaatgacaatgcgtgcccgaaacttcattagcaattttaatttcgccccggtcctgtggtcctgtgatctcgccctgcctccayttgccttgtgatattctattaccttgtgaagtacgtgatctctgtgacccacaccctattcgtacactccctccccttttgaaaatccctaataaaaacttgctggtttttgcggcttgtggggcatcacggaacctaccgacatgtgatgtctcccccggatrcccagctttaaaatttctctcttttgtactctgtccctttatttctcaagccagccgacrcttagggaaaatagaaaagaacctacgtgattatcggggcaggttccccgata

SEQ ID NO: 312 - DNA, 1071 bp, Homo sapiens
  repeat_region (1)..(1071): mer11c
  misc_feature (563)..(563): n is a, c, g or t
tgttgcgggaagtcagggaccccaaacggagggaccggctgaagccatgrcagaagaacgtggattgtgaagattttatggacatttattagttccccaaattaatacttttgtaatttcttatgcctgtctttactgcaatctctaaacataaattgtaaagatttcatggacacttatcacttccccaatcaatacccttgtgatttcctatgcctgtctttactttaatctcttaatcctgtcagctgaggaggatgtatatcgcctcaggaccctgtaataattgcattaactgcacaaattgtacagcatgtgtgtttgagcaatatgaaatgtgggcaccttgaaaaaagaacaggataacagcaattgttcagggaataagagagataaccttaaactctgactgccggtgagccaggcagaacagagccatatttctcttctttcaaaagcaaatgggagaaatatcgctgaattctttttctcagcatggaacatccctgagaaagagaatgcgcacctrggggtaggtctctgaactggcccccctgggcgtngcctgtctcttatggtcgagactgcagrggtgaaatagactccagtctcccatagcgctcccaggcttattaggaagaggaaattcccgcctaataaattttggtcagaccggttgatctcaaaaccctgtctcctgataagatgttatcaatgacaatggtgcccgaaacttcattagcaattttaatttcgcctcggtcctgtggtcctgtgatctcgccctgcctccacttgccttgtgatattctattaccytgttaagtacttgatgtctgtcacccacacctattcgcacactccctccccttttgaaaatccctaataaaaacttgctggtttttgtggcttgtggggcatcacggatcctaccaacgtgtgatgtctcccccggatgcccagctttaaaatttctctcttttgtactctgtccctttatttctcaagccagccgacgcttagggaaaatagaaaagaacctacgtgattatcggggcaggtcccccgata

SEQ ID NO: 313 - DNA, 897 bp, Homo sapiens
  repeat_region (1)..(897): mer11d
tgtagggagaccccctgaaactattgctacggaataaaagatgaaatgctcctgattattgtaaatacaaaattgcatgcaggattgtgtaaagacaatgccaggttggactgccagaacgagccaacagcgcgtgatgtgcttccccctgcagagagcctatgaatggacgtgcagtcagggaggtttcacatcaccaagattcctatcccagaaaagcagatgttcatagctctgggaatggaatgcgacccttgtggagagcctataaacggacgcatggggggcgcctgtccatatggataagatagggctataaacgccctcatcttgccacggctcttctaggcctctttagggttaaggcatactcccttctgagaatttctggtctaaccggttgtctagcttcacgtcctgtttccatggattgtttgtaaccagcttttgttgcaattgttactgctgattaatatcttgctaatcataggttatggaaagaytgtgtttctgttttaaggctctgttagaaattactgacgcacacactatattgtaaattcttatctctgtatactgtacttctacatacaaatgtactgtacttctacatacaaatgttatgttaaagaattacttcatccccatgtgaccatctcacctcataatcaaatgaccctaaatccctcactaacctacccccgccctcactaaacttaataataaatgctggtatatccagtgcattgttggcaccgtgggaccagaaggcggtgacccccctggacccagctttcactatcttgtgtgtgtctattatttctcaacctgccgatccgcctaggagcaaagagagagccccgttgcattgcgggctgctggccagatcccgcaata

SEQ ID NO: 314 - DNA, 467 bp, Homo sapiens
  repeat_region (1)..(467): mer1a
gctgcacagcaggaggtgagcggcgggcgagtgagcgaagcttcatctgtakttacagccgctccccatcactcgcattaccgcctgagctccacctcctgtcagatcagcggtggcactagattctcataggagcgcgaaccctattgtgaactgcgcatgcgagggatctaggttgcgcgctccttatgagaatctaatgcctgatgatctgtcgctgtctcccatcacccccagatgggaccgtctagttgcaggaaaacaagctcagggctcccactgattctacattatggtgagttgtrtaattatttcattatatattacaatgtaataataatagaaataaagtgcacaataaatgtaatgcacttgaatcatcccgaaaccatcccccccccctggtccgtggaaaaattgtcttccacgaaaccggtccctggtgccaaaaaggttggggaccactg

SEQ ID NO: 315 - DNA, 337 bp, Homo sapiens
  repeat_region (1)..(337): mer1b
caggggtccccaacccccgggccgcggaccggtaccggtccgtggcctgttaggaacygggctgcacagcaggaggtgagcggcgggcgagtgagcattaccgcctgagctccgcctcctgtcagatcagcggcggcattagattctcataggagcgcgaaccctattgtgaactgcgcatgcgagggatctaggttgcgcactccttatgagaatctaatgcctgatgatctgaggtggaacagtttcatcccgaaaccatccccgccccccggtccgtggaaaaattgtcttccacgaaaccggtccctggtgccaaaaaggttggggaccactg

SEQ ID NO: 316 - DNA, 345 bp, Homo sapiens
  repeat_region (1)..(345): mer2
  misc_feature (81)..(81): n is a, c, g or t
cagtcggccctccgtatccgtgggttccacatccgtggattcaaccaaccgcggatcgaaaatattcagaaaaaaaattgnatggttgcgtctgtactgaacatgtacagacttttttccttgtcattattccctaaacaatacagtataacaactatttacatagcatttacattgtattaggtattataagtaatctagagatgatttaaagtatacgggaggatgtgcgtaggttatatgcaaatactacgccattttatatcagggacttgagcatccgcggattttggtatccgcggggggtcctggaaccaatcccccacggataccgagggacgactg

SEQ ID NO: 317 - DNA, 218 bp, Homo sapiens
  repeat_region (1)..(218): mer20
cagtggttctcaaccgggggtgattttgccccccaggggacatttggcaatgtctggagacatttttggttgtcacaactggggggggggratgctactggcatctagtgggtagaggccagggatgctgctaaacatcctacaatgcacaggacagcccccacaacaaagaattatccggcccaaaatgtcgatagtgccaaggttgagaaaccctg

SEQ ID NO: 318 - DNA, 798 bp, Homo sapiens
  repeat_region (1)..(798): mer20b
  misc_feature (145)..(145): n is a, c, g or t
  misc_feature (437)..(437): n is a, c, g or t
  misc_feature (525)..(525): n is a, c, g or t
cagtggttctcaactaggattgtattaccccctaggggacatttggcaatgtctggagacattttttggttgtcacaatgattgggggggrtgctactggcatttagtgggtagaggccagggatgctaaacatcctacaagcantgcacaggacagtcccccacaacaaagaattgtcctgcatcccacatgactttcaaatgtcccactagacattcatgtaggtgaaaaaacctgtttataattatctgagcctagaacctaactctgttttacatataaacacaaagtattttttgcatagttttaatatacactgaattttctaggaatgcaactacvattgtatgtaaattgagggaagattgtactttgttttgtttagaactttaccaaagagttgttcaccattttggaaaatcatatcactaatggncaatactcgctcatggtatttgagttgccaatacaacacacctgtatcagtctgcatttgtagctgtcacattcacggtgattctatngtataggtgcaagcatctgactacttcattatgtcttctagtgtagtcatgcctgagcatttacatattgaaatacatattattttattataaattactttccttttttctcttttatattacagttagagcattatattgattttttttaaaattaatgtgtataggtaggttatattatctatgaatttcatttcaggataaataaaagaggcattacaaaatatttgttataaaaaggggtattgggtctgatagggttgagaaccactg

SEQ ID NO: 319 - DNA, 933 bp, Homo sapiens
  repeat_region (1)..(933): mer21
  misc_feature (226)..(226): n is a, c, g or t
  misc_feature (580)..(580): n is a, c, g or t
  misc_feature (608)..(609): n is a, c, g or t
gccctyctrttkcagraaaacctctctcaaaccatgttttycctctgctstcataccacgacaacagtcgtcaacacagaagacttctgtgaccaaatgtgtggaggattttccccacacaccaagcagcagacaccagctgggcgtcctccaaytcagttccgacactgtctacctggagatagcgtcagatcccacaggttgaggtctcagtccccaagactgnccccaccttcagayacagttgcaagyccgggyctctggaacttctgaccaactggcttcaarttggggttcccacgacacctctttaggttcgaytaatttgctagagtggytcacaaaactcarrgaaacacttattawgtttactggtttattaatagatgatatttcaaaggatacagatgaagagatacatacggggcggtctggaagrkcccagcgcaggagcttccgtcytgatagrrttggggttacaccctccagattcttcaccttctgtyagcctccacgtgttcagctctccagaagctcyctgaaccctgtcctttgggccttttatggagayctcattggntgtccatgactgaagcatggacgaytgnnawaatgtgattggrcaaaaagggtctgatctaatcccagcaaggyctgtccagattcttcttggtctctttgtgcagcattccttcctccagggtatggggcaggaccycctctggaatgagggtcttacgacccacaatcagattatagagtcctgccttgggcggmtgaaargaggrcargagaaggycagagaratattctgtttcctgaggcctaaagcacctctacattatagcgaaagactgtaaccatggtcatgtgagttatggacaagaaccatggacaaaaacacatatacaatcatatcccacctcccaacgc

SEQ ID NO: 320 - DNA, 795 bp, Homo sapiens
  repeat_region (1)..(795): mer21b
  misc_feature (404)..(404): n is a, c, g or t
  misc_feature (408)..(409): n is a, c, g or t
  misc_feature (436)..(437): n is a, c, g or t
  misc_feature (546)..(546): n is a, c, g or t
  misc_feature (672)..(672): n is a, c, g or t
  misc_feature (674)..(674): n is a, c, g or t
  misc_feature (717)..(717): n is a, c, g or t
  misc_feature (722)..(722): n is a, c, g or t
tcaacacacaacacttctgtcaccaaacgtgtggrrrtttttccccacacacaaacaaktcttcagttctgcggcggacaccarctgggtgtcctccaattcarttcagttctgacactawctacctrgagatagcgtcagatcccacaggtttaagggctcagtcccacaagactgcccccacttcagatrccagtcgcaagtctrggttktcacccgtacttctgaccaactggctataaattgttcccacgacccctctttaggttcgattaatttgctagaatrgctcacaraactcagggaaacacttatatttaycggtttattataaaggatattacaaaggatacagatgaacaaccagatgaagagatrcatagggcgaggtmtgggagagtccngggnncaggagcttccgtgccctctctggstnnrccaccttccwggcacctccacgtgttcaccaacccggaagctctccgaaccctgtccttttgggtttttatggaggcttcattacgtaggcatgaytgattacatcantggccattgattatcaactcaacctycagcycctctccyctccccagaggttggagggtggggctgaaagttccaaccytctaatctgccttggtctttctrgcgaccagcycccatccwgragcntnctaggggctgcccrccakgagtcgmctcattagmacaaaagrncrtynctattacccaggarattccaagggttttaggagytctgtgtcaggaaccggggtcaaagaccaaatattagat

SEQ ID NO: 321 - DNA, 1503 bp, Homo sapiens
  repeat_region (1)..(1503): mer22
gtgatggctgcacgctcggtccaggaagaggcggaggaagcccaccgctcctgacattggccttctaggaaaggcggtgttgcatcccacctgcacttcctctctgattcttgagggccaaccgcttcctccgctcctggggaaagtgccttctagcaccgaatcttttggctgccacggatgtcagggagccaacgggactgggttttggctgggtgcaggggaggttgcgtcaggggtactagccggcggcgggctgggggtggggtgtactttgtccaaactcccggctcctctggcgggcctccctgaacgtggcgtggactcgcgcacaggccctgtctcgcaggttttcaggtgcgcttggcttttcctccgctttgtggggcaggtctccagtgcccccggcgcacgcctggacatcactgtccgtctcgtcgtcgcccctacggcctcaaagacacacgctgcctgcatgtgctcttgggggacgacagtgcacatgtggacacactggctccagctcggactcgcctctgtctctctttgcccgtgtcgccggaagccgcctcgggttgccggagccctcgggccttggagatgaaggcaggcccctgctcctgccaggaaggagggaggcagtgggctcatgggtcggtgcctttgcagccgacagcacgtgcggccctggggatcttcctgtgccccggcgagaccctttccgcctcactgcattggaaccccattcccgatcacccgctgggatccatcatcggactccaagaggagtccgcgcagccagccggcaccccgaagctcctccttcagcgggaaccgaagcagaagagcgatcaaggaggtcctcaccacaggactcctatgggtccgaccctgggtctcccgcaggcccctctggcagtcctcttcccacccgccgcctcggcttcgccgccgccgccgcaacctccagcaccgccccccaggccccgcagccgccgtcgccgccattttttaaagggtcgcagcctgactctgcggagtaagggggggtggagcgggggagtcgctcgccagcatgcgcgagcccgagccgccgcttgggtcacagtgaaagccaccgttgcccggggatgggtccctgacacttggggaagtaggagccctgtgtgatcgtgcgtctgagtctgggctgagaccagtcctggccagggcagttaccaggacggtctcggaggccgggattcgcggagggtccagcagcaggaagaaaccccaggaggaagaaacctcagacagatcgccggcgaggcagcgcgggatcccagcctcaggcgtgcgcggacggtgtgcgggtgagtctccccaaaagtggagcccttgtgatgacgagcacaggtccgcctgcgtgcccgtgggcggctctctcaccggtggctctcagtcgcggagagcagaacccgcagcttcaggggctgctgcgggagggtgttccctgctgtacgt

SEQ ID NO: 322 - DNA, 434 bp, Homo sapiens
  repeat_region (1)..(434): mer28
  misc_feature (122)..(122): n is a, c, g or t
  misc_feature (132)..(132): n is a, c, g or t
  misc_feature (382)..(382): n is a, c, g or t
cagttgacccttgaacaacatgggtttgaactgcgtggrtccacttatacgcggattttcttccatctctgccaccctgagacagcaagaccaacccctcctcctcctcagcctactcaacntgaagacgangaggatgaagacctttatgatgatccacttccacttaatgaatagtaaatatattttctcttccttatgattttcttaataacattttcttttctctagcttactttattgtaagaatacggtatataatacatataacatacaaaatatgtgttaatcgactgtttatgttatcggtaaggcttccagtcaacagtaggctattagtagttaagttttkggggagtcaaaagttatacgtggatttttnactgcgcggggggtcagcgcccctaacccccgcgttgttcaagggtcaactg

SEQ ID NO: 323 - DNA, 209 bp, Homo sapiens
  repeat_region (1)..(209): mer3
cagcgctgtccaatagaactttctgtggtgatggaaatgttctatatctgcgctgtccaatacggtagccactagccacatgtggctaytgagcacttgaaatgtggytagtgcgactgaggaactgaatttttaattttatttaattttaattaatttaaatttaaatagccacatgtggctagtggctaccatattggacagcgcag

SEQ ID NO: 324 - DNA, 230 bp, Homo sapiens
  repeat_region (1)..(230): mer30
caggggtgtccaatcttttggcttccctgggccacactggaagaagaagaattgtcttgggccacacataaaatacactaacactaacgatagctgatgagctwaaaaaaaaaaaamaatcccamaaaaatctcataatgttttaagaaagtttacgaatttgtgttgggccgcattcaaagccatcctgggccgcgtgcggcccgcgggccgcgggttggacaagcttg

SEQ ID NO: 325 - DNA, 190 bp, Homo sapiens
  repeat_region (1)..(190): mer30b
cacgggtgtccaatcttttggcttccctgggccacattggaagaagaattgtcttgggccacacataaaatacactaacactaacgatagctgatgagctaaaaaaaaaaggtctgtgcataattttcgtgatatccaccaccacagataagcaaaaaagtccttgcattcaaagggttggacaccgctg

SEQ ID NO: 326 - DNA, 483 bp, Homo sapiens
  repeat_region (1)..(483): mer31
  misc_feature (99)..(99): n is a, c, g or t
tggtgacaaagactctctccttgaccaaactttagtcaggctcctctgagccctcttctcaactaagccccgaccttgggcyctgtccttggcctgcwnagtccagttttagcaagaatcctgctaagtcagtttagagagaatcccccaccctcgatatctgatcaggttcctcatcctccgccatcccccaggcgatgtctgatcaccctggcctgccttcagcaagaatcctgttaggtcagtttagcmagaatccccctacccctgatgtytcctcttagtaattttccatccactgacccccaccctgctccttggctataaatccccacttgtccttgctgtattcggagttgagcccaatctctctcccctactgcaaaatcccattgcagtggtccctgtacctatcgcaatggtcctgaataaagtctgccttaccgtgctttaacaagtgtcgttgaataattttctctgaca

SEQ ID NO: 327 - DNA, 485 bp, Homo sapiens
  repeat_region (1)..(485): mer31a
tgacaaagattctctgcttgaccaaactttagtcaggctcctgaaccttctcctaggcccatctgtgcacttccttgtaaaatccagttttagcaaagaaccctgctaagtcagtttagcmagaaccccccacccttgatatctgatcaccctcaatatctgatcgggttcctcatcctccaccatcccccaggtgatgtctgatcaccctggcctgtcttcagcaagaatcctgttaggtcggtttagccagaatccccctacccctgatgtttcctcttagtaattttccatccactgacccctcaccctgctccttggctataaattcccacttgcccatgctgtattcggagttgagcccaatctctctcccccactgcaaaatcccattgcagtggtccctgtacctatcgcaatggtcctgaataaagtcttccttaccatgctttaacaagtatcattgaataattttttctttaaca

SEQ ID NO: 328 - DNA, 466 bp, Homo sapiens
  repeat_region (1)..(466): mer31b
  misc_feature (70)..(70): n is a, c, g or t
  misc_feature (392)..(392): n is a, c, g or t
tgacaaagactctctccttgaccaaactttagtcaggctcctctgagccctcttctcaactaggcctcgnccttgggccctgtccttggcctgcwtagcccagttttagcaagaatcctgctaagtcagtttagcgagaatcccccacccttgatatctgatcaaattcctcatcctccaccatcccccaggtgatgtctgatcaccttggcctgccttcagcaagaatcctgttaggtcggtttagcaagaatccccctacccttgatgtctcctcttagtaattttccatccactgacccctcactctgctccttggctataaatccccacttgtccttgctgtattcggagttgagcccaatctctctcccctattgcagtggtctttncacctattgcaatagtcctgaataaagtctgccttaccattttaacwagtgtctgaataattttttctttaaca

SEQ ID NO: 329 - DNA, 4936 bp, Homo sapiens
  repeat_region (1)..(4936): mer31i
  misc_feature (193)..(194): n is a, c, g or t
  misc_feature (1230)..(1230): n is a, c, g or t
  misc_feature (1695)..(1695): n is a, c, g or t
  misc_feature (1939)..(1940): n is a, c, g or t
  misc_feature (1948)..(1948): n is a, c, g or t
  misc_feature (2165)..(2165): n is a, c, g or t
  misc_feature (2312)..(2312): n is a, c, g or t
  misc_feature (2375)..(2375): n is a, c, g or t
  misc_feature (2405)..(2405): n is a, c, g or t
  misc_feature (2415)..(2415): n is a, c, g or t
  misc_feature (2418)..(2418): n is a, c, g or t
  misc_feature (2467)..(2467): n is a, c, g or t
  misc_feature (2496)..(2496): n is a, c, g or t
  misc_feature (2504)..(2504): n is a, c, g or t
  misc_feature (2574)..(2574): n is a, c, g or t
  misc_feature (2823)..(2823): n is a, c, g or t
  misc_feature (3057)..(3057): n is a, c, g or t
  misc_feature (3453)..(3453): n is a, c, g or t
  misc_feature (3911)..(3911): n is a, c, g or t
  misc_feature (4073)..(4073): n is a, c, g or t
  misc_feature (4221)..(4221): n is a, c, g or t
  misc_feature (4699)..(4699): n is a, c, g or t
gttgtggtgccacaggcctctgacccagaacctgaagtatgcacctttgaaacctttgtcttcactcttggctgactgatcgggaatccattggtaagcccaactcttgagccagtgctccagatggcagtctgttgaagcatggtgaggatacattttgattcttaaggtccaggcttcttttgaaaggtannatacctcctgggctggaagwttttcctcctggctctttgtttcgagtggggattcactccctgactcctgggctggmagtctttttttggccctctgtgaggcctctctgttctctctatctgatccttctcctcccataggaacttctcagtcgactgaaacccctttctcgaacccctgcwgactatatgctccgccaactctgtccacctccttccttgttggcacgattttgctgaggataatttggaacttcagtggcctctttgggaaacttgagatctccccaaactggctcctctaagacctctcccttcccattgcctctgctcctccttctgccaccttcgatcttctcttcagtttccttgaatcctttgatatgtcccccttcaagcccctacctcctccacccctctatccacccctgccagacctttyccttctcactccagcccctcaactccctatagtcattagagctttaggcctcctgccmcawcagggggcgckcgaggggctcagggacacccaaaagcaaccacccgaggctgaaaaggctarctggaaacagactggatattttatccactcagatggactttggagacatccagacgtccgcttggtgtctcctcagtccctcacctaaaatttagtccacagcctctatcggattacacatcagggcaaagaaaatcttaaaggtctcctccacaaatattsgtrgaaagctttagccctcatgttgagyaggtaacctcaacttgtcccatctgccagaaacacaattcagataaaaatataaagtggggcaaagataatgagccaactctcttatattaaccagtgagttttgtattwctgtgtttatgcctgattcatggctaaaattttagaatkaaagctgtaagatctctatttgtatctgtctgtatgtttatgtatgtatgttatgtatatgtgatatttttctacctccagatggtattaccaaattaatttataaaatcccttaaggagctctattcaaantgacttagagataaatgagacttatataaattaaatattcctaaaactcccagaaatatarraactaacccaaatgcttttcaatttcacatgatttgggtaaatctttggcaaataaaattagtttaatattgttggtttaattaaaaaagggtatgtcttctgagttatcagcattaaatataatacaagcatacatatttattctacytgggtttagcagtatgttatctctactaaatatttaaagttataaaaattataaatttaacctaagaatgaatgaagaagtgcagtatccatcacttcatgcatatcaagcagagcagttaaacaaaacccatgtatttaacatttttaggtttttgttttgttgatgcttgcctaacatgaacatgctataaaattagttaacagaaaaataacttgaagtgatgttttagccttgtatgatgttataatatnatagcctaaaaacagtttccaaatatttggtgatgtgaaaccttagagttatgctaagttaaattaagtaatagatattcattaaataactagatcatttctaaggaagataaactactaaaacactactaaatctaagtttatgtttatatactttttggttcttatttttatatggtacagagaggctaaaatatattcgagcctcttaataaacatgaaaaattgtattataaaaagtagnntatacctntaaaaattatgagatggtatattcataaaatttgctaatgtgcacatacagaatcctggtatatgacagacagttcacaattgcctacttcccagtttttttctgtaaaagaaaagttattgatggttaaaaaatattatctatctatctatatatataattaaaactactagaaacaataagactgagggaaacaactttgtatgcaaaatatgcnagggtagtaggttagatttttaataaagtatataaaatatgaaaaatgtgttttcgttaaggaaaaaaagagtaattttgtcctaaagtaaaatgagtgattgttcaaaatgagaaaggggaaaagtgtaggactaaagctaaatanatattttttaaaagttgtaaaagttgtggaaaaggaattttatgtgtagtcaagatgctaatntatttataaggattttttaagctcaawtantgtactaatncanaactataatttggtttccgctctgttgaaaggacaaagttttcttaaantattgtaaaagatttttctttaccttttnaataattnacctaggaagcaaagattttgtgtcttatcaagataaattccctgtgcttcatgttgtctttatcatatntttaattacttttgaaagcaaatcttttcaattttaaaaaagctagggttatttttctcgagtatgttacttcctatatttacctctggaatcttttattgccactttgattaaatggataaccaagtatatttcatagcgacccgtaatcctatttaatcaagcgttcaaaccttttgacatttttgacaaacttcccaaaatcacaattttaaatgaagtctttttgacctccaacctaactttganattttccggagggcctctgaaaaatctctaaagaacttgttctttcaccttgtaaaagagagatattaaactaattaggcttatttcatatgttaaattacatgggaagcattgtcaaataagaaatggtgcttaaccttctttgagttatatttgtatgggtacctgttattaatataagtgttccagaaattgtatgaggttcctaaaaatttgtcaatacccttgctcttnatgatatgtccagcataattatgttatcagtcataattgcagttattatgttaaaatgytgtatgccacagaamtaaccaaatttgcttgtcaagtgaactctcatcagatctttaaccatgactattttaagtcttttgtcactcacagacagtttttgttttactctgattcttctctgaaagcatcttacaakcagctacagggcaaagtgcttcatcttcaaagaagctcatgagaaagacaggtactctgaaatataaacctctgatactttgcagaccatgccactggactgagtaagaatttccagacttgaatgaagaaactgacgggttcatgaaactgctaacccaagatcaagcagaacaagaattaattacatgggactgaatnaaccgatgaggatgatttatagttttttatgttttttgtttgaaacattgctggttctttaatgttttgttttccagattcaaggaaactttttcttttcttttaagctatctataacttacagcaatttggtaaagtatacttttgtgaacaaaawtgaaacaattacttttctctctacctgatccctccagaattcggaaactattagtgagtattcttattttcatggcaatatagttatttgcataagttcagtaagaatctgttctccttgtaacaggacacaattggaaacactggttatattaccaaggctttgactagaatgtcatatttgggaatgatgggcatagaattagctttaaggaactaaagttgactttatggaaccaatgcttacaaagccctcttggaaaaatcggcctggtacctggcttacasggttcccggccttncaggtgagtaaggaaagtcactttctggcaggcccaaggacctcaggatattttggggacctcaagaagagaggaattcacccaaatctatagatattgcaggtgaagtctgatggcgaaatccttggcttggcttcatagccttgagaagcttttaaaagnccaatctgagattccttattaaaagttccagcaaagcaaaccttaaaagagcctatgtggtcagtcactattcttgctgcatttatgtaaataatcaggccaagtctaatgagatcagacttattttgcaaacaagttagtcttactntgattatctttggtaaaaaggggagtgaggtgactatagagagaaattttatgtttcagtggaaaactatagcgcacccattatcagattctagtcctgttcattgtttttggttttattatctacctgcaaactggactggatcctgaatttttctagttttctccaatatctggctacaactctccaaactaatgtttccaatttttctcccacccttctggcttggaatcactgaaaattaaaactgcccttttcctgaagccctgcaagctgaaactggacgacttgatataaacttcagagaaatcaccacaacagatcatgtgtgggcagccttcatgacacccaaactgcaaaccaggaaagcctgccagctgccactgcctacctcactccagctgaagatgcttcaagcccagcatctagaaatcttattgaccggctgccctctggactcagaaactgagtttccaantgttaacctttgtttttattttattttcatagaaactaaactcccctcattaaaggcctgatggctcacaccatccagsaaatatcctctgctaccaagtcccagcagatgattcagctggtccttaatgaacaaaaggcmacccaacaagaaaatggacttatattgttcaaaggaaagaagaatgtctcttctttccttraacaagaggagggactgacaaagattctctgcttg

SEQ ID NO: 330 - DNA, 324 bp, Homo sapiens
  repeat_region (1)..(324): mer33
ctgcgctgtccaatacggtagccactagccacatgtggctattgagcacttgaaatgtggctagtccaaattgagatrtgctgtaagtrtaaaatatacaccagatttcaaagacttagtacgaaaaaaagaatgtaaaatatctcattaataatttttatattgattacatgttraaatgataatattttggatatattrggttaaataaaatatattattaaaattaatttcacctgtttctttttacttttattaatgtggctactagaaaatttaaaattacatatgtggctcgcattrtatttctattggacaacgctg

SEQ ID NO: 331 - DNA, 546 bp, Homo sapiens
  repeat_region (1)..(546): mer34
  misc_feature (540)..(540): n is a, c, g or t
tawtgaaggagatcagaatatgccaccccaaaatatgccactttggcataaggattattttgagctaaaggcacttgagaaacagcagrtgcaagaagagcactctgaccttcctcttttcttcctgaaagcaggagataaaactcccatgtgaaagacgttctctctataccaggaggaaggaaacattcttatcgtcagagacggggagtcgaggccgagggaaatctgtacgaacaaaccttgttaaactaacyctyatcttcctagtcacttctccacgatgaaccgccctagcccaaacccctttgtcttgtcacgttttcacaatttactactctttgtccaacctagtatawaagcgttcgactctaaccgcttctttgggtcttcatttccttatgagggctcccatgtacatgtaaaacatacttaaataaatttgtatgcttttctcctgttaatctgtcttatgtcagtttaattatcgggcccagccggaaactctaagagggtagaggwaaaatttttccttcyctnccatgg

SEQ ID NO: 332 - DNA, 1351 bp, Homo sapiens
  repeat_region (1)..(1351): 11mc5
  misc_feature (38)..(38): n is a, c, g or t
aaaaaaaaaayacatttctascctttccactgaaaagncctagaaacaatgactaatccaatagcaatgagtaccctyaggacccagattgtggtctctaaataccatttcccactaaaaggaaccagggctccttggagaaatggctaattccaggtctggggcaggaaatgtacaagatgagcctggaacatcttgtcataccagatagcaaggaagctataaaactactagggttgtgtcaaaaggactcaggagccaacttactggccaaagatgggacaatttgagcatcaataataactgcaatttaacacatcaaatatrtttaaatccatgagtttataataaaaaaatctaattggtcacctttggagtgatgctagggaaccaactcattattttgaaaactggtaaataaagggaaagaatcaagcatttatcttgcctttcctatataaactgtacctcwgggtaaccaaatagtwgatgagggaaatttctctttatagaagtattccagctaataaatgaagaaaaaattagaattagaatatcaccattttgcaacccctaatgaattaatggatctaggcaatgatcatcaatggctgctaacatcacaaaaactarasatytgcctcctgatggaartawacaacaccacctatgaaatattagtcttgccaaaaaaaaatcaaacctgaatctgatcaagcctctagatctaactaccaatttacaggaaatacagaggacagaggaacatgttaaatgacaccatrgggatgcaatcagcaaaatccagactgtgggaaactctacaggacaaatrttaacttttcttcaacaaataaattatgagaaaaaaaagatggaagaagaacctatagattaaaagagacttaaaagacatatcaaccaattacaatgtatggaccttatttggatcctgattcaaamaaatrtaaactataaaaatatatrtgtatacaattggaaatttgaacactgactagatatttgatgatattaaggaattattgttatttttaggtgtgataatggtattatagttattttataaaatagtccttatcttttagagatacatactgaaatatttatagataaaatkatatgatgtctgggatttgcttcaaaataatccaggagggaggaagtaggtggagctatagatgaaacaaaattggccatgaattgataattgttgaagctgggtgatgggtatgtggaagttcattatactattctctctacttttgtatatttgaaatttttctaatwttaaaaataaagaccaatttgttggacattaatttgttggcaa

SEQ ID NO: 333 - DNA, 1095 bp, Homo sapiens
  repeat_region (1)..(1095): l1mca_5
  misc_feature (10)..(10): n is a, c, g or t
  misc_feature (15)..(15): n is a, c, g or t
  misc_feature (27)..(28): n is a, c, g or t
  misc_feature (32)..(33): n is a, c, g or t
  misc_feature (36)..(36): n is a, c, g or t
  misc_feature (369)..(369): n is a, c, g or t
  misc_feature (704)..(704): n is a, c, g or t
  misc_feature (765)..(765): n is a, c, g or t
ttaakatagngaatnttcttcaaaatnnatanntanaaaacgataacaggacttctagtttccggtcccgcatgtaaggagcttgaaagttgccactccatcctaacaacaagtaaaaagctgaacaaactgaaaaatcaacaactcttcttagatccgtaagagaagtgaggtcatagggcaaaccactgcccccagaattggagagacaaacaggtgaatacagagaatcacaacttaccggagcagaaactcataagcagaaacctctgtgggaaccagtaccggggtaggaaaacctgaactgtaattgacaaattgctggaggctcagtgtggacaagtctgagagttgaaaactccaggggancccagtcattaggtgacccccacacttttgtgagttttacctccaggagcytgaccaggttctcacagtgaatatcggagaaaaatccccttgtgcttccggcaagaggagaggaaaaggaacaattctgaaatataccasagcattctgttcttttaacaaagtcctgccctcaggagaaactatttaaccagagcctaacctgttagagttttwtcagagcctaaccgacctgggggaagggaaatacccaactccagccccctctagccatcctgtcccacctaaagggagaaaaaaagctaagaaacacttgtgaagttcacagyccaggngcacaggctcactaaaagactgagaactaatcataggactatagaacacttccctcccccncataccttaccaccacattactaaaagcctatttacaacagttccttttacccagtacatcatgtccggctttcaacaaaaaattacaaggcatactaaaaggcaaaaaaaaaaaacacagtttgaagagacagagcaagcatcagaaccagactcagatatgacagggatgttggaattatcagactgggaatttaaaataactatgattaatacgctaagggctctaatggaaaaagtggacaacatgcaagaacagatgagtaatgtaagcagagagatggaaactctaagagaagaatcaaaagaaaacgctagaaatcaaaacat

SEQ ID NO: 334 - DNA, 1197 bp, Homo sapiens
  repeat_region (1)..(1197): l1mcb_5
  misc_feature (11)..(11): n is a, c, g or t
  misc_feature (52)..(52): n is a, c, g or t
  misc_feature (123)..(123): n is a, c, g or t
  misc_feature (288)..(288): n is a, c, g or t
  misc_feature (373)..(373): n is a, c, g or t
  misc_feature (755)..(755): n is a, c, g or t
tgacatgtaangagcttggaagttggcactcccttcaacaacaacaaaaagntgaacaaacagaaaaatcaatgacttttcttagatccataagagaagtgaggtcacagggcaaactgtcancctgaaatctggagagacaggcgcatgcagagaatcacagcagagctctgctttcctgaagcagaagcctctgggagcacaagctggtaggaaaacttaaatggtaattttggcaaattgctagaggctgagtgtggactagtttgagagtaagaaattctcggnggcccagtctaggggaacctccacactttcgtgggctttacctccaggagtcccactagtttctcacagtgaagatccgagaaanttcgcttcacggctctggcagggggaggggaaaagcaatcattktgaaatacgcccagagtattctccgtaacaaactcttgccctacaggagaaaatactttgccagagccttatcctagctttagggaagggtaatcacccaactccagccccctctagccttcctgtctcacctaaagggagaaaaaaagctaagaaacacttgtgaaggtcacagcccagggactcaggcccactaaaagactgagatttaatcataggattatagaacgtttcccttccccmataccttaccaccacatcaacagggctccagtataataacaatggattacagctgaaagaactgcaaaacmcagactctatttaagaaggagctnctagggaaacccaaagacaggagaggagacaaaaacaaggacaccggagtraagtttagcctctgacacctacagctacagcaaacagtaaacacagtctaactcttagccagataaacataaaacctcacattaaaggcctatttacttcagttccttttacccagtacatcatgtccggctttcaacaaaaaattacaaggcatactaaaaggcaaaaaaaaaaaacacagtttgaagagacagagcaagcatcagaaccagactcagatatgacagggatgttggaattatcagactgggaatttaaaataactatgattaatacgctaagggctctaatggaaaaagtggacaacatgcaagaacagatgagtaatgtaagcagagagatggaaactctaagagaagaatcaaaagaaaacgctagaaatcaaaacat

SEQ ID NO: 335 - DNA, 1536 bp, Homo sapiens
  repeat_region (1)..(1536): l1mcc_5
  misc_feature (490)..(490): n is a, c, g or t
  misc_feature (513)..(514): n is a, c, g or t
  misc_feature (521)..(521): n is a, c, g or t
  misc_feature (525)..(525): n is a, c, g or t
  misc_feature (556)..(557): n is a, c, g or t
  misc_feature (567)..(567): n is a, c, g or t
  misc_feature (575)..(575): n is a, c, g or t
  misc_feature (585)..(586): n is a, c, g or t
  misc_feature (589)..(589): n is a, c, g or t
  misc_feature (689)..(689): n is a, c, g or t
  misc_feature (692)..(692): n is a, c, g or t
  misc_feature (709)..(709): n is a, c, g or t
  misc_feature (711)..(711): n is a, c, g or t
  misc_feature (718)..(718): n is a, c, g or t
  misc_feature (725)..(726): n is a, c, g or t
  misc_feature (731)..(731): n is a, c, g or t
  misc_feature (741)..(741): n is a, c, g or t
  misc_feature (768)..(768): n is a, c, g or t
  misc_feature (917)..(917): n is a, c, g or t
  misc_feature (982)..(983): n is a, c, g or t
  misc_feature (985)..(986): n is a, c, g or t
  misc_feature (988)..(989): n is a, c, g or t
  misc_feature (1336)..(1336): n is a, c, g or t
  misc_feature (1338)..(1338): n is a, c, g or t
  misc_feature (1347)..(1347): n is a, c, g or t
  misc_feature (1482)..(1482): n is a, c, g or t
aggaacttccactttcagttctacttccacttaggatgtagaaagccacaaragaatattgctcccatcctaacaatragaaaaaaagccagataatctacaaaatyatacttttcttgagcccatcagagagctgaggtcacaaggcaaccaagtaaactgaattccaaagagtgacaagcccctccaaggagaracaggacacaygaactgtttcacctttggcagagcataggaggaagaggtggccaccataaaagcaggtaagaagaaatcagctaaaattttaataaattcttaaaggccaagtgtgggctagtgtgwcagtttagaaagctgggagccccagacacaagggaagtttgcactcacttgcaagctcttttccatgggcctccaccaggtgctcatgagaaagactgggggcagggcaggagactgaagaaagccctcctcagkggcacaggcatgcaggaggtgatcggctgcngctgggggacaggaacgaagccnncctcatnttcncagaactttcttyccyaaagcaaaagccttnngctrctgggntgasaggnagcaaacccnnttnctcccagggcckwrgcaaaracactmtwsyttytysrgaagmggtargagcyaaaccwtctgattctgggggaagaacagaagcaaaagccttctscycnygngraagggcagrraacwntntyaggyncaggatnntgcantgatacaaancagaggtcwgctactactgggagaggnacaggtcccatcccaaccacagatacaaggagagtttgactgccatggagagaggggcaggaacactgagaaagccccactcctgaggcccaggcgcacagggcctgcctaagactgaggctggaccaggacaacagagaacatccctnctcccaccacaagcctaacaagcaccaagtaacamagcaacagcagtctaccactgggggagggnnannannatggagagagactccctctgtggcacaggtatgcagggactactgaaagctgagggtggagcaggaacactgagaaaaaccctctagcaaaccagcccccacactaagcacaaggtaacagcagcccaccactagaggaatttgaagcctgtggtgcactgarggtaaccatagcaacaacaaaacccaaacccagctcaactcctgactagattgactcaacccccacactaaaagcctagcagaagaaaaggcatgcccatttccaggcataaatactatttacctcagtctctactgttcttctacacataatgtctrgcattcaataaaaaattacaagacananaaaaaaagnaaaaaaaaacaacccattgtcaagagacaaagcaatcaacagaaccagactcagatatgacacagatgttggaattatcagacaaagaatttaaaataactatgattaatatgttaaaggatctaatggaaaaanggtagacaacatgcaagaacagatgggtaatttcagcagagagatggaaactat

SEQ ID NO: 336 - DNA, 971 bp, Homo sapiens
  repeat_region (1)..(971): l1md1
  misc_feature (927)..(927): n is a, c, g or t
cttgtatccagaatatataaagaactctcaaaactcaacaataaaaaaacaaacaatctaattaaaaaatgggcaaaagacatgaagagacatttcaccaaagaagatatacaaatggcaaataagcacatgaaaagatgttcaacatcattagctattagggaaatgcaaattaaaaccacaatgagatatcactacacacctattagaatggctaaaataaaaaataatgacaayaccaaatgctggcgaggatgtggagaaactggatcactcatacattgctggtgggaatgtaaaatggtacagccactctggaaaatactttggcagtttcttataaagctaaacatacamttaccatatgactcagcaattayactcctaggtatttatcccagagaaatgaaaacttatgttcacacaaaaacttgtacacgaatgttyatagcagctttattcataatagccmaaaactggaaacaacccagatgtccttcaacgggtgaatggttaaacaaactgtggtatatccataccatggaatactactcagccataaaaaggaatgaactattgatacatgcaacaacctggatgaatctccagaaaattatgctgagtgaaaaaagccagtctcaaaaggttacatactgtatgattccatttacataacattcttgaaatgacaaaattwtagarwtgragarcagattcctggttgccaggggttagggacgggggtgggggtggagggaggtgggcatsstggagttccctgtggtgatggaaatgttctgtatcttcactgtatcaatgtcaatatcctggttgtgataytgtactatagttttgtaagatgttaccattgggggaagctggatgaagggtacacgggatccctctgtattatttcttacaattgtntgtgagtgtgtaattatttcaaaataaaaagtttaatttaaaaa

SEQ ID NO: 337 - DNA, 1088 bp, Homo sapiens
  repeat_region (1)..(1088): l1md2
  misc_feature (840)..(840): n is a, c, g or t
  misc_feature (920)..(920): n is a, c, g or t
  misc_feature (1044)..(1044): n is a, c, g or t
cttgtatccagaatatataaagaactctcaaaactcaacaataaaaaaacaaacaatctaattaaaaaatgggcaaaagacatgaagagacatttcaccaaagaagatatacaaatggcaaataagcacatgaaaagatgttcaacatcattagctattagggaaatgcaaattaaaaccacaatgagatatcactacacacctattagaatggctaaaataaaaaataatgacaayaccaaatgctggcgaggatgtggagaaactggatcactcatacattgctggtgggaatgtaaaatggtacagccactctggaaaatagtttggcagtttcttataaagttaaacatacamttaccatatgacccagcaattayactcctaggtatttatcccagagaaatgaaaacttatgttcacacaaaaacttgtacacgaatgttyatagcagctttattcataatagccmaaaactggaaacaacccagatgtccttcaacgggtgaatggttaaacaaactgtggtatatccatacmatggaatactattcagccataaaaaggaatgaactattgatacatgcaacaacctggatgaatctcaagaacattatgctgagtgaaaaaagccagtctcaaaaggttacatactgtatgattccatttatatarcattcttgaaacgacaaaactatagagatggagaacagattagtgrttgccaggkgttagggatrcaggraggaggtggatgtgrytataaarrggtagcatgagrgaatytttatggtgatggaacwgttctgtatcttgaytgtggtgrtggttacacgaatntatacatgtgataaaattgcatagaactaaatayryryryrataagtacaagtaaaactggcgaaatctgaataagatwnatggrttgtaycaatgtcaatwtcctggttktgatattgtaytatagttttccaagatgttaccattgggggaagctaggtgaagaacacacgggatcccyctgtattatttcttacaattgtntgtgagtktayaattatttcaaaataaaaagtttaatttaaaaa

SEQ ID NO: 338 - DNA, 1604 bp, Homo sapiens
  repeat_region (1)..(1604): l1md_5
  misc_feature (959)..(959): n is a, c, g or t
  misc_feature (1352)..(1352): n is a, c, g or t
ttaaaaacaaagcgggagacttccgcttccgggaagatggagtagacgtacttttccctattcctcccgctaagtacaactaaaaaccctggacattatatataaaacaaacataagaagactctgaaaggtggagagaagaaggcagaccggctagggacctcgggacccgaggaacgacacggtagtgagttccctgggttttctttttgcctcatatatcccagacttggagctgaagaagccggcaacccggaaacgccaacgggcacagacaaaaaaagccccaacaaaagcctgctctctctagccaaaggaccaggaaaggggcagcctagcaagacagaaaacttttagacaataaccgctctactccagccaaacaccacagaaaaaactgtggccccacccccacccacgccagcaaaggccgagtggggagcctagacttccaccctcaccaggctgtaacgaggcgccccaacacctccaccgggatggtgtcagagaaggccaagtagggagctgggactttcatccccgccaggcggtaatgaggcccmccttccccttgccmctgcggtgtcagtggagaccacgtggggagcctggacttccacccccacccggcagtaatgaggcgcccctccccctccctactggggtggtgtcagaggaggcctagtggagagtcgggactttcaccaccgcccagcggtaatgaagccacctcctcctcttgccmccatggtgtcagtggaggccacgtggggagcagtaatgaggcactcctacccctcccagccagggaggtatcagcggaggcctagtggggagccgaactcccacccccgcccagcagtaacgaggagcccctccctcacctcgggtgtcaacggaggccgagtggggaacctggacttctacccccacctggcagtaatgaggcagcgcccctncccctcycctgccggagcggtgtcagaggaagccggctaaaacagaaggtttaaataagatccagagtctcataacataatacccaaaatgtccaggtttcaatcgaaaatcactcgtcataccaagaaccaggaaratctcaaactgaatgagaaaagacaatcaatagacgccaacaccgagatgacagagatgttagaattatctgacaaagattttaaagcagccatcataaaaaatgcttcaataagcaattacgaacgtgcttgaaacaagaraaaagtagaaagcctcagcaaagaaatagaaagtctcagcaaagaaatagaagatataaagaagaaccaaatggaaattttagaactgaaaaatacaataaccgaaataaaaanctcaatgratgggctcaatagcagaatggaggggacagaggaaagaaccagtgaacttgaagatagagcaacagaaattacccattctgaacaatagagagaaaatagattggaaaaaaaaatggacagagcctcagggacctgtgggactataacaaaagatctaacattcgtgtcatcggagtcccagaggagaggaaaaagagrrtagtatttgaagaaataatggctgaaaatttcccaaatttggca

SEQ ID NO: 339 - DNA, 503 bp, Homo sapiens
  repeat_region (1)..(503): l1mde_5
  misc_feature (108)..(110): n is a, c, g or t
  misc_feature (112)..(112): n is a, c, g or t
  misc_feature (269)..(269): n is a, c, g or t
  misc_feature (289)..(289): n is a, c, g or t
  misc_feature (290)..(290): n is a, c, g or t
gaagtactctccttccccaccaggcctgagactcctcccctaccaagagataccaaggtgaccaggtggcaccagcaagagggatcctgccacaacaagcagcctggnnnancctggaagcactctctttccccatgggcctgagactcccctcccctacccagagacaccaggtatgcyaggcagcactagcaagggggatcctgccacaacaagcacctagcccaggaagcctctttatccccatgggcctgggagactcccttccncacccacatcccctcccctnnccccacctagagacaccaggcagcctggcctggggaagctccttctgccccctcaggcagcaccagcagggaccagtgggagccccagtagcaccagataaaccaagcagaccaaaatagcactgcaaaggctctgaaaattaaactgtcattggaaccacagcccacaaaaggtaggccaggacctacatgctaaacctaaacagggtgact

SEQ ID NO: 340 - DNA, 1089 bp, Homo sapiens
  repeat_region (1)..(1089): l1me1b_5
  misc_feature (296)..(296): n is a, c, g or t
  misc_feature (670)..(670): n is a, c, g or t
  misc_feature (765)..(765): n is a, c, g or t
  misc_feature (1003)..(1003): n is a, c, g or t
  misc_feature (1058)..(1058): n is a, c, g or t
  misc_feature (1065)..(1065): n is a, c, g or t
cagacttccgcttccggtaatggtggagtaagctcctaccggaccaaccctcccgcagataacaactataaactctggacaaaatacaaaaaacaactacttgaaggcactggagagtgaccaaaagcaggcagaaactggaggggagtcgacacctggaagaagggaatwgcacggagtgagttcccatttctacggctttttgcctgagagcaggccgcagttggtgcgtcgtacagatggctaaaacwtcagtagaaaacccgcggtcttactggcttgaagaaccagagaanagaattcggggcaaccacagccactggaaagtgaggggaaaatcccggaaaggagagagccagagagaggatccccaaattctgtgtataaactctgcccaaatctctggctgacccctgaaccacgcatgcgcggagcagactccaagcagcccagctaaagacaaaagaactgaactgagattggagctgccgcccaagaaacagagtttgcagttcgagtccagccaagytaactgcctactaaaacaaaagaaacaacactctttagagaaaaataacagaatccagagtctccacaatktaacattcatgatgtccaggatacaatcccaaaattatacmagataagaagaaacagraaaaatgtaatncatccttaagagaaaagaaaataaaaaccgaccctgagatraaccagatgttggaattaacagacaaggactttaaagcarctattataaatatnttcaatgaaataaaacaaaatatgctcacaatgaataaaaggataggaaatctcagcagagaaatagaaacgataaaaagaaccaaatggaaattctagaamtgaaaaatataatatctgaaacaaaaaattcactgaatagacttaacagcagaatggagatgacagaggaaagagtcagtgaacttaaagatagatcaatagaagttatacaatctgaagagcagagagaaaaawnatttawaaaaaaagwgmakagtctcacaaacatgtgcgacaatatcaaaaggtcnaacatanatgtaattggaatcmcagaaggag

SEQ ID NO: 341 - DNA, 911 bp, Homo sapiens
  repeat_region (1)..(911): l1me2
  misc_feature (647)..(647): n is a, c, g or t
  misc_feature (708)..(708): n is a, c, g or t
cttgtatccagaatatataaagaacgcctacaactcaacaataaaaaaacaaacaacctaattaaaaaatgggcaaaagacttgaataggcatttcaccaaagaagatatacagatggccaataagcacatgaaaagatgctcaacatcattagtcatcagggaaatgcaaattaaaaccacaatgagataccacttcacacccactagaatggctaaaattaaaaagaccgacaayaacaagtaytggcgaggatgtggagcaactrraactcycatacattgctggtgggaatgtaaaatggtacaaccactttggaaaayagtttggcagtttctcaaaaagttaaacacgcacctaccctatgacccagcaattccactcctaggtatttacccaagagaaatgaaaacatatgtccacacaaagacttgtacaagaatgttcatagcagctttattcataatagccmmaaagtggaaacaacccaaatgtccatcaacaggagaatgaataaacaaattgtggtatatccatacaatggaatattactcagcaataaaaaggaatgaactaytgatacacgcaacaacatgaacgaatctcgaaaacattatgttgagcgaaagaagccagacacaaaagantacatactgtatgattccatttatatraaattcwagaacaggcaaaactaatctataatgntagaaatcagaatagtggttgcctctggkgagggtraatgactggraagggrcatgagggaattttctggggtgatggaaatgttctatatcttgatcggggtggtggttacacgagtgtatacatttgtcaaaactcatcgaactgtacacttaaaatctgtgcattttactgtatgtaaattatayctcaattttaaaaaa

SEQ ID NO: 342 - DNA, 909 bp, Homo sapiens
  repeat_region (1)..(909): l1me3a
  misc_feature (647)..(647): n is a, c, g or t
  misc_feature (657)..(658): n is a, c, g or t
  misc_feature (705)..(705): n is a, c, g or t
cttgtatccagaatatataaagaacgcctacaactcaacaataaaaaaacaaacaacctaattaaaaaatgggcaaaagacttgaataggcatttcaccaaagaagatatacagatggccaataagcacatgaaaagatgctcaacatcattagtcatcagggaaatgcaaattaaaaccacaatgagataccacttcacacccactagaatggctaaaattaaaaagaccgacaayaacaagtaytggcgaggatgtggagcaactrraactcycatacattgctggtgggaatgtaaaatggtacaaccactttggaaaayagtttggcagtttctacaaaagctaaacacgcgcctaccctatgacccagcaattccactcctaggtatttacccaagagaaatgaaaacatatgtccacacaaagacatgtacaagaatgttcatagcagcattgttcataatagccaaaaagtggaaacaacccagatgtccatcaacaggagaatgaataaacaaattgtggtatatccatacaatggaatactactcagcaataaaaatgaatgaactaytgatacacgcaacaacatgaacgaatctcgaaaacattatgttgagcgaaagaagccagacacaaaagantacatactgnntgattctatttgcataaaatacaaaaccaggcaaaactaatcaatgntgttagaagtcaggatagtggttgttctgggaatagtaatgactgtaaggrarcatgagagggctttctggggtgctggtaatgttctgtttcttgatctgggtgctggttacacggctgtgttcartttgtgaaaattcatyaagctgtacacttatgatwtatgcayttttatgtatgtatattatayytcaataaaaaaaa

SEQ ID NO: 343 - DNA, 596 bp, Homo sapiens
  repeat_region (1)..(596): l1me4
  misc_feature (121)..(121): n is a, c, g or t
  misc_feature (435)..(435): n is a, c, g or t
  misc_feature (455)..(455): n is a, c, g or t
  misc_feature (475)..(476): n is a, c, g or t
  misc_feature (478)..(478): n is a, c, g or t
tttggcaatatctatcaaaatcacacatacatttaccctttgacycagcaatcccacttctaggaatttatcctacagacatacttgcaacatgtacaaaatgacatatatacaaagttantttattgcagcattatttgtaatagcaaaaaaytggaaacaacctaaatgtccatcaataggaaaatggttaaataaattatggtatatccatacaatggaatactatgcagctataaaaaagaatgaagaagatctctatgtactgatatggaatgatctccaggatatattgtttaagtgaaaaaagcaaggtgcaagaatagtgtatatagtatgctaccttttgtgtaaaaaagaaggaaaaataaaaatatatatatatatttgcttatatatgtataaaataactctggaaaaataaacaagaaactnataacagtggttgcctcttntggggggaggggaactgggnngntgggtggctgggggacatgtgggatggacagggatgggagggactgacttttcactgtatacctttttgtactttgtactttttgaaattttgaaccatgtgaatgtattacctattc

SEQ ID NO: 344 - DNA, 1089 bp, Homo sapiens
  repeat_region (1)..(1089): l1mea_5
  misc_feature (296)..(296): n is a, c, g or t
  misc_feature (670)..(670): n is a, c, g or t
  misc_feature (765)..(765): n is a, c, g or t
  misc_feature (1003)..(1003): n is a, c, g or t
  misc_feature (1058)..(1058): n is a, c, g or t
  misc_feature (1065)..(1065): n is a, c, g or t
cagacttccgattccggtaatggtggagtaagcccctaccggaccaaccctcccgcagaaaacaactataaaacctggacaaaatacaaaaaacaactacttgaaggcactggagagtgaacaaaagcaggcagaaactggaggggagtcgacacttggaagaagggagcwgcacggagtgagttcccatttctgtggcttttagcctgagagcaggccgcagttggtgcggcgtacagatggctaaaacwtcagtagaaaacccgcggtctttctggcctggagaaccagagaantgaatctagggcaaccacagccactggaaagagtggggaaaatcccggaaaggagagagccagagagaggatccccaaattctgtgtataaactctgcccaaatctctggctgacccctgaaccacgcatgcgcggagcagactcaaagcagcccagctaaagacaaaagatctgaactgagactggagctgccgcccaagaaacagagtttgcagttcgagtccagccaagataactgcctactaaaacaaaagaaacaacactcattagagaaaaataacagaatccagaatctccacaatktaacattcatgatgtccaggatacaatcccaaaattatacmacataagaagaaacagraaaaatggaatncatccttaagagaaaagaaaatcaaatccgaccctgagatraaccagatgttggaattaacagacaaggattttaaagcarctattataactatnttcaatgaaataaaacaaaatatgctcacaatgaataaaaggataggaaatctcagcagagaaatagaaacgataaaaagaaccaaatggaaattctagaamtgaaaaatataatatctgaaacaaaaaattcactgaatagacttaacagcagaatggagatgacagaggaaagagtaagtgaacttaaagatagatcaatagaagttatacaatgtgaagagcagagagaaaaawnatttawaaaaaaagwgmakagtctcacaaacatgttcgacaatatcaaatggtcnaacatanatgtaattggaatcmcagaaggag

SEQ ID NO: 345 - DNA, 2523 bp, Homo sapiens
  repeat_region (1)..(2523): l1mec_5
  misc_feature (6)..(6): n is a, c, g or t
  misc_feature (439)..(439): n is a, c, g or t
  misc_feature (898)..(898): n is a, c, g or t
  misc_feature (948)..(949): n is a, c, g or t
  misc_feature (967)..(967): n is a, c, g or t
  misc_feature (1101)..(1101): n is a, c, g or t
  misc_feature (1134)..(1134): n is a, c, g or t
  misc_feature (1144)..(1144): n is a, c, g or t
  misc_feature (1175)..(1176): n is a, c, g or t
  misc_feature (1267)..(1267): n is a, c, g or t
  misc_feature (1339)..(1339): n is a, c, g or t
  misc_feature (1723)..(1723): n is a, c, g or t
  misc_feature (1821)..(1821): n is a, c, g or t
  misc_feature (1839)..(1840): n is a, c, g or t
  misc_feature (1870)..(1870): n is a, c, g or t
  misc_feature (1950)..(1950): n is a, c, g or t
  misc_feature (1992)..(1992): n is a, c, g or t
  misc_feature (2164)..(2164): n is a, c, g or t
  misc_feature (2406)..(2406): n is a, c, g or t
  misc_feature (2494)..(2494): n is a, c, g or t
aatgtnttaaaaaattcactkaaaacataatasaagacttctgcttccggcyaagatggagtaacagggaccggatttaccctcctrcctgaaacaacyaaaacgcggacaaaatatatgaaacaacggttttcaagacattgracatcaggcagcgmaggacagcgatccctgrgagaagggaaacgaatgaggtgagccctrtgatcgccycagcttactgcctkgagatagtttccaggccacggcacagagaggagaaacccaggcagagcccggcggwctccctgagttgaggagacggagctgagagtycgrggaggccaaggctggctagagttcgcagggcagaataccagagaggagaaagccgcamagagagaacttctgagatctgcagagggtccccytcgagtcttcagctgagtactgaycagcncatgcatgcgaggaaacyacccgaggctagggaaagaaccmcacgaaaggattararggaacaatccccagagctcacacagggccgggaatagttcctgtttccaccagccagagtggaaaacctcataattcacggggcatcgggtagagtactcagaagggttttgcctcagtagcggggaaaaattagccctaaactaaacactgctctggtcccacctaacaaatcttaaaagcaagcctcgaaaagatcaaactgtttccaagtaacttaactgcatcccagaataaagctcaagaatatttawaggaatacaaaaatatccagcacccaamaaggtaaaattcacaatatctggcatccaatcaaaaattaccaggcatccaaagaagcaggaaaatacgacctataatgaggagaaaaatcaatcaatagaaacagacccagaaatgacanagatgatagaattagtagacaaggacatttaaamagttattataactctnnymwatatgttcaagragntaaagaaaaacatgaacataatgaagaaagagrtggaagatataaaaagacccaaatagaacttctagagatgaaaawtayaatrtctgaaatgaaaaatacactggatgagattaacagcagattagacactncagaagaaaraattagtgaacttgaagacatancaatagaaantatccaaaatgaaatacagagacaaagaaannaaaaayagacaaataaaataaagcgtcagtgagctgtgggacaacttcaagtggcctaayacacgtrtwattggagtcaaaaagaaagganagagagaatgaggyagaagaaatattggaagaaacgatagctgagaattttccaaaattgatgaaagacatnaatctacakattcaagaattccaatgaatsccaagyaggataratacagaagaaacaacacatctwgacatatcatagtcaaatcgyagaaaaccaaagayaaagagaaaatcttaaaagcagtcagagaraaacaacatattacgtacagggggacaacaatacaaattaaagctgactttttaccaggcacagtggaggccagaagacagtgggatgawatatttaaagtgctgaaagaaaagaactgtcgacccggaattctatatccagcgaaaatatctttcaaaaataaaggcaaaataaagacattctcagacaaacaaaagctgagataattcattaccagcagacctgcgctacaagaaatgttaaaggaagtcnttcaagcagaaagaaaatgacaccagatggaaacatagatctacacaaagaaatgaagagcgccggaaatggtaamtatacgggtaaatataaaaganatcctttcttattatttnnaatttctttaaaagataattggctgtttanagmaaaaataataacaatgtattgtggggtttataacatatgtaarcaaaatgtatggcaacaatagcacaaaggccggnaggggagaaatggaagtataytgttgtaaggttcttatactntacgtgaagtggtataatrtcatttgaaggtagactgtgataagttaaagatgcatattgtaaaccctagagcaaccactaagataacaaaacaaagagttatagctaataagccaacaaaggagataaaacggaatcataaaaaatacccaattaatccaaaaaaaggcanwaaaaaaaaaatggaacaaagaamagatgggacaaatagaaaacaaatagcaaratgatagatttaaacccaaccatatcaataattacattaaatataaatggtctaaacgctccaattaaaagacagagattgtcagaatggataaaaaaacgagacccaaatatatgctgcctacaagaaacccactttaaatataaagacacaaataggttaaaagtgaaaggatgaaaaatgatatntcatgttaacgccatccaaaagaaagctggagtagctatattaatatcagacgaagtggatttcagaggaaagaataccgccaagagncaaaaaaggtcattttataatgataaagg

SEQ ID NO: 346 - DNA, 990 bp, Homo sapiens
  repeat_region (1)..(990): l1p2_5
ataaaaaaattaatgagaagaggattctgggaagatggcagagtaggaagcaccaggaatctgtctccccacctagacaacaattgcactggcagaatctgtctgatgtaactattttggaactctggagtctattgaaggcttgcaacttccaggggaaggcttggatggtaaattgtggttaatttcggtcaatttcagctcttagcacagtagcagctacccatcccccacccccagccccgtggcaggcagctgtgcacgtgttcctggagcagcttgcacacagcttgcgggagccagggtgggcaaaaaggatcctgtcctccaaatatcggggatctgtgctctgatcgctgattgctgcttctgatcacagaggtgcagacaaagaggtggcggccattgttgtcgcacctcccyccattgttgcaagcccctccccctctggctgaagtgacttccaggggatttaaagggctagtaccctttctccgctttatttttcttttttccccttttgggagccagacattaaagactaggacattcaaaagcaactgcatatacggggaaaattagaaagtcaccgtgcatgcccagggaaaggcacaggctcagaaaagacctgagaagaccttaagtttacacctcaggctgatccttggcacagagacagcctacaacaataaaaacaaaacaaaaaaataacaaaaacacagcaaaccctggggaagagggagaatctgatttccagagttaccacattattagattcaaatgtccagttttcaacaacaacaacaaaaaatcacaaggcatacaaagaaacaggaaagtatggcccattcaaaggaaaaaaaataaatcaacagaaactgtccctgaaaaagacctgatggcagatctactagacaaagactttaaaacaactgtcttaaagatgctcaaagaactaaaggaaaacgtggagaaagtcaagaaaatgat

SEQ ID NO: 347 - DNA, 1727 bp, Homo sapiens
  repeat_region (1)..(1727): l1p5a1
  misc_feature (729)..(729): n is a, c, g or t
ggtggctggcaagatggccgaataggaacagctctggtctgcagctcccagcgagatcaacgcagaaggcaggtgatttctbcatttccaactgaggtacccggctcatctcattgggactggttagacagtgggtgcagcccacggagggcgagcagaagcagggtggggcgtcgcctcacccgggaagcgcaaggggtcagggaactccctcccctagccaagggaagccgtgagggactgtgccacgaggaacgrtgcattccggcccagatactatgcttttcccatggtcttcgcaacccacagaccaggagattccctcgggtgcctacaccaccagggccctgggtttcaagcacaaaactgggcagccgtttgggcagacaccgagctagctgcaggagtttttttttttcgtaccccagtggcgcctggaacgccagtgagacagaactgttcactcccctggaaagggggctgaagccagggagccaagtggtctagctcagtggatcccacccccacggagcccagcaagctaagatccactggcttgaaattctcgctgccagcacagcagtctgaagtcgacctgggatgctcgagcttggtggggggaggggcatccgccattactgaggcttgagtaggcggttttcccctcacagtgtaaacaaagccaccaggaagttcgaactgggcggagcccaccacagctccgcaaancggctgtagccagactgcctctctagattcctcctctctgggcagggcatctctgaaagaaaggcagcagccccagtcaggggcttatagataaaactcccatctccctgggacagagcacctgggggaaggggcggctgtgggcgcagcttcagcagacttaaacgttcctgcctgccagctctgaagagagcagcggatctcccagcacagtgctcgagctctgctaagggacagactgcctcctcaagtgggtccctgacccctgtgcctcctgactgggagacacctcccagcaggrgtcgacagacacctcatacaggagagctccggctggcatctggtgggtgcccctctgggacgaagcttccagaggaaggaacaggcagcaatctttgctgttctgcagcctccgctggtgatayccaggcaaacagggtctggagtggacctccagcaaactccagcagacctgcagcagaggggcctgactgttagaaggaaaactaacaaacggaaagcaatagcatcaacatcaacaaaaaggacgtccacacagaaaccccatccgaaggtcaccaacatcaaagaccaaaggtagataaatccacgaagatgaggaaaaaccagtgcaaaaaggctgaaaattccaaaaaccagaacgcctcttctcctccaaagaatcacaactcctcgccagcaagggaacaaaactggacggagaatgagtttgacgaattgacagaagtaggcttcagaaggtgggtaataacaaactcctccgagctaaaggagcatgttctaacccaatgcaaggaagctaagaaccttgaaaaaaggttagaggaattgctaactagaataaccagtttagagaagaacataaatgacctgatggagctgaaaaacacagcatgagaacttcgtgaagcatacacaagtatcaatagccgaatcgatcaagcagaagaaaggatatcagagattgaagatcaact

SEQ ID NO: 348 - DNA, 7678 bp, Homo sapiens
  repeat_region (1)..(7678): l1p_ma2
  misc_feature (513)..(513): n is a, c, g or t
  misc_feature (2757)..(2757): n is a, c, g or t
  misc_feature (4117)..(4117): n is a, c, g or t
  misc_feature (4115)..(4115): n is a, c, g or t
  misc_feature (7396)..(7396): n is a, c, g or t
gaaggcggaacaagatggccgaatagaagmctccaccgatcatcctccctgcaggaacaccaaattgaacaactatccacacaaaaarstaccttcataagaaccaaaaatcaggtgagcgatcacagtacctggttttaacttcatatcactgaaagaggcactgaagagggtaggaaagacagtcttgaattgccgatgccaccactccyccatkcccgggcagtggcwgwgtggtgtggagagagaatctgtgcgcttgggggagggagagtgcagkgattgtgagactttgcattggaactcagtgctgccctgtcacagtagaaagcaaaaccaggcagaactcagctggtgcccacggagggaacatttagaccagccctagccagaggggaatcgcctatcccagtggtcggaacctgagttccggcaagccttgccaccgcgggctaaagtgctctggggytctaaataaacttgaaaggcagtctaggccamaaggactgcaantcctrggcaagtcctagtgctgwactgggctcagagycagtggacttgggggacacatgacctaaggagacaccagctggggcagcyaagggagtgcttgcaccacccctcyctyaactccaggcagcacagctcacggctccgaaagagactccttccttctgcttgaggagaggagagggragagtaaagaggactttgtcttgcaacttggataccagctcagccacagtaggatagggcaccarkcagagtcmtgaggcccccwttccaggccctggctcccggacaacatttctagacacaccctgggccagaagagaacccgctgccttgaagggaaggacccagtcctggcaggatkcatcacctgctgactaaagagcgcttgggccctgaatgatcarcagcgrtacccaggcartactcastgtgggccttgggtgagactcagagacttgctggcttcaggtgtgactcagcacattcccagctgtggtggctatggggagagactccttytgcttgagaaaagsagagggaaaagtaaaggggactttgtcttgcaccttaggtaccagctcggccacagtgggrtagagcaccaagtaggctcttggggtccccgattccaggacttggctcttggatggcatttctggacctgccctgggccagaggagagcccactgtcctgaagagagagtcccaggcctggcagcattcaccacaagctgactgaagagcccttgggccttgagwgaacattggcggtagccaggcagtactctccatgggcctgggrtggtggtggccacagggagcgactcctttgcctgtggaaaggggagggaagagtgggaaggactttgtctcgtggtttgggtgccagctcagccacggtagaatagagcaccaggtagatttctaaggtttctgactccaggccctggctcccggatgacatctctggacctgcctgrggccwgggggaacttaccaccctgaagggaaggacacaagcctggctkgcttttscayctgctgattgtagagccctagggccttgagcgaacataggcggtagccaggyagtggttacagcaggccttgggtgagacccagtgctrtgctggcttcaggtctgacccagcacagtcccagtggtggtggccacaggggtgcttgtgtcaccmctcccagcttcaggcagctcagmacagagagagagactccatttgtttgggggraagtaagggaagagaacaagagtctctgcctggtaatccagagaattcttccggatcttatccaagaccaccaaggcagtacctctatgagtctgcaagaaccacagtgttaytgggcttggggtgccccctaawgcagatatggctacatgaccaaaarcttagatcayaacacccaagtccsttcaaatacctggaaagccttcccaagaagratgggtacaaacaagcccagactgtgaagactacaataaatacctaactcttcaatgcccagacactgacgaacatccacaagcatcaagaccttccaggaaaacatgacctcaccaaacgaactaaataaggcaccagtgaccaatcctggagaaacagagagatatgtgayctttcagacagagaattcaaaatagctgttttgaggaaactcaaagaaattcaagataacacagagaaggaattcagaattctatcagataaatctaacaaagagaytgaaataattawaaagaatcaagcagaaattctggagctgaaaaatgcaattggcatactgaagaatgcatcagagtctyttaacagcagaattgatcaaacagaaraaagaattagtgagcttgaagacaggctatttgaaaatacacagtcagaggagacaaaagaaaaaagaataaaaaacaatgaagcatgcctacaagatctagaaaatagcctcaaaagggcaaatctaagagttattggccttaaagaggaggtagaaagagagataggggtagaaagyttakttcaarggataataacagagaacttcccaaacctasagaaagatatcaatattcaagtacaagaaggttatagaacaccaagcagatttaacccaaagaagactacctcaaggcatttaataatcaaactcccaaaggtcaaggataaagaaaggatcctaaaagcagcaagagaaaagaaataacatgcaatasagctccaatacgtntggcagcagacttttcagtggaaaccttacaggccaggagagagtggcatgacatatttaaagtgctgaaggaaaaaacttttaccctagaatagtatatccagtgaaaatatccttcaaacatgaaagagaaataaagactttcccagacaaacaaaagctgagggatttcatcaacaccagacctgtcctgcaagaaatgctaaagggagttcttcaatctgaaagaaaaggacgttaatgagcaataagaaatcatctgaaggtacaaaactcactggtaatagtaagtacacagaaaaacacagaatatcgtaacactgtaattgtggtatgtaaactactcatatcttaartagaaagactaaaaaatgaaycaatcaaaaataataactacaacaattttcaagacatagacagtacartaagatataaatagaaacaacaaaaagttaaaaagagaggggatgaagttaaagtgtagagtttttattagttttcgattgtttgcttgtttgtttatgcaawcggtgttgttatcagcttaaaataatgggttataagataktatttgcaagcctcatggtaacctcaaatcaaaaaacatacaacagatacacaaaaaataaaaagcaagaaattaaatcataccaccagagaaaatcaccttcactaaaagaaagacaggaaggaaggaaagaaggaagagaagaccacaaaacaaccagaaaacaaataacaaaatggcaggagtaaatccttacttatcaataataacattggaatgtaaatggactaaactctaatcaaaagacatagagtggctgaatggataaaaaaaacaakacccaatgatctgytgcctacaagaaacacacttcacctataaagacacacatagactgaaaataaagggatggaaaaagatrttccatgcaaatagaaaccaaaaaagagcaggagtagctatacttatatcagacaaaatagayttyaagacaaaaactataagaagagacaaagaatgtcatttaatgataaaggggtcaattcagcaagaggatataacaattttatatatatgcacccaacactggagcacccagatatataaagcaaatattattagagctaagagagagatagaccccaatacaataatagctggagacttcwmcacctgtcttttagcattagaaawatcwtccagacagaaaatcaacaaagaaacattgkacttaatctgcactatagaccaaatgracctaatagayatttacagaacatttyatccaacagctgcagaatacacattcttctcctcagcacatgratcattctcaaggatagrccatatntnaggtcacaaaacaartcttaaaacattcaaaaaattgaaattatatcaagyatcttctctgaccacaatggaataaaactagaaatcaataacaagagraattttggaaactatacaaacacacggaaattaaacaayatgctyctgaatgaccagtgkgtcaatgaagaaattaagaaggaaattkaaaaatttcttgaaacaaatgataatggaaacacaatataycaaaacctatgagatacggtaaaagcagtactaagagggaaagtttatagctgtaagtgcctacatcaaaaaagaagaaaaacttcgaataaacaacctaatgatgcatcttaaagaactagaaaagcaagagcaaaccaaacccaaaattagtagaagaaaataaataataaagatcagagcagaaataaatgaaattgaaataaagaraacaatacaaaagatmaatgaaacaaaaagttggttttttgaaaagataaacaaaattgacaaacctttagccagaytaagaaaaaaagagaagacccaaataaataaaatcagagatgaaaaaggagacattacaactgataccacagaaattcaaatgatcattagaggctactrtgagcaactatataccaataaatcggaaaacctagaagaaatggataaattcctagacacatacaacctacyaagattgaaccatgaagaaatccaaaacctgaacagaccaataacaagtaacgagatcgaagccgtaataaaaagtctcccagcaaagaaaagcccgggacctgatggcttcactgctgaattttaccaaacatttaaagaattaataccaatcctactcaaactattctgaaaaaagaggaggaaggaatacttycaaactcattctatgaggccagtatyaccctgataccaaaaccagacaaagacacatcaraaaaawaaaactacaggccaatattcctgatgaatattgatgcaaaaatcctyaacaaaatactagcaaaccaaattcaacaacacattaaaaaratcattcatcatgaccaagtgggatttatcccagggatgcaaggatggttcaacatatgcaaatcaatcacaatcgatrtgatacatcatatcaacagaatgaaggacaaaaaccatatgatyatttcaattgatgctgaaaaagcatttgataaaattcaacatcccttcatgataaaaaccctcaaaaactgggtatagaagaacatayctcacgacacaataaaagccatatacgacagacycacagctagtatcayactgaatggggaaaaactgaaagcctttccyttawgatctgraacatgacaaggatgcccactttcaccactgttattcaacatagtactggaagtcctagttagagcaatcagacaagagaaagaaataaagggcatccaaattggaaaggaagaagtcaaattatccttgtttgcagatgatatgatcttatatttggaaaaacctaaagactccaccaaaaaactattagaactgataaacaaattcagtaaagttgcaggatacaaaattaacatacaaaaatcagtagcatttctatatgccaacagtgaacaatctgaaaaagaaatcaagaaagtaatcccatttacaatagctacaaataaaattaaatacctaggaattaatktaayaaaawaaktgaaagatstctayaatgaaaactataaaacactgatgyaagaaattgaagaggacacaaaaaaatggaaagatattccatgtttatggattggaagaatcaatattgttaaaatgyccatactacccaaagcaatctacagattcaatgcmatccctatcaaaatacyaatgacatttttcacagaaatagaaaaaacaatcctaaaatttatatggaaccacaaaagacccagaatagccaaagctatcctaagcaaaaagaacaaaactggaggaatyacattacctgacttcaaattatactacagagmtatagtaaccaaaacggcatggtactggcataaaaacagacacatagaccaatggaacagaatagagaacccagaaacaaatccatacatytacagcgaactcattttcgacaaaggtgccaagaacatacactgaggaaaagacartctcttcaataaatggtgctgggaaaactggatatccatatgcagaagaatgaaactagaccccatctctcgccatatacaaaaatcaaatcaaaatrgattaaagacttaaatmtaagacctcaaactatgaaactactaaaagaaaacattggggaaactctccaggacattggatttgggcaaagatttcttgagtaataccccacaagcacaggcaaccaaagcaaaaatggacaaatgggatcayatcaagttaaaaagcttctgcacagcaaaggaaacaatcaacaaagtgaagagacaatycacagaatgggagaaaatatttgcaaactacccatctgacaagggattaataaccagaatatataaggagctcaaacaactctataggaaaaaaatctaataatctgatttaaaaatgggcaaaagatctgaatagacatttctcaaaagaagacatacaaatggcaaacaggtatatgaaaaggtgctcaacataaytgatcatcagagaaatgcaaatcaaaactacaatgagatatyatctcactccagttaaaatggcttttatccaaaagacaggcaataacaaatgctggygaggatgtggagaaaagggaaccctcgtacattgttggtgggaatgtaaattagtacaaccactatggagaacagtttggaggttcctcaaaaaactaaaaatagagctaccatataatccagcaatcccactgctaggtatataccccaaagaaaggaaatcagtatattgaagagatatctgcactcccatgtttattgcagcaytgttcacaatagccaagatttggaagcaacctaagtgtccatcaacagatgaatggataaagaaaatrtggtacatatacacaatggagtactattcagccataaaaaagaatgagatcctgtcatttgcaacaacatggatggaactggaggtcattatgttaagtgaaataagccaggcacagaaagacaaacatcgcatgttctcacttatttgtgagakctaaaaattaaaacaattgaactcatggaaayagagagtagaaggatggttaccagaggctgggaagggtagtgggaggkngkgggaagtggggatggttaatgggtacaaaaatatagttagatagaatgaataagayctagtatttgvtagcacaacagggtgactacagtcaaaaataatttattgtayatttwraaataactaaaagagtataattggattgtttgtaacacaaaggataaatgcttgagatgatggataccccatttaccctgacgtgattattatgcattgtatgcctgtatcaaaatatctcatgtaccccataaatatatacayctattatgtacccayaaaaat

SEQ ID NO: 349 - DNA, 912 bp, Homo sapiens
  repeat_region (1)..(912): l1pa11
ctaatatccagaatstacaargaacttaaacaaatttacaagaaaaaaacaaamaaccccatcaaaaagtgggcaaaggacatgaacagacacttctcaaaagaagacatwtatgtggccaataagcacatgaaaaaaagctcaacatcactgatcattagagaaatgcaaatcaaaaccacaatgagataccatctcayrccagtcagaatggcaattattaaaaagtcaagaaacaacagatgctggygaggctgtggagaaataggaatgcttttacactgttggtgggaatgtaaattagttcaaccattgtggaagacagtgtggcgattcctcaaggatctagaaccagaaataccatttgacccagcaatcccattactgrgtatatacccaaaggaatataaatcattctattataaagacacatgcaygtgtatgttyattgcagcactattcacaatagcaaagacatggaatcaaccyaaatgcccatcaatgatagactggataaagaaaatgtggtacatatacaccatggaatactatgcagccataaaaaagaatgagatcatgtcctttgcaggaacatggatggagctggaggccattatccttagcaaactaaygcaggaacagaaaaccaaataccgcatgttctcacttataagtgggagctaaacgatgagaacacatggacacatggaggggaacaacacacactggggcctgtcggagggtggagggtgggaggagggagagcatcaggaaaaatagctaatggatactgggcttaatacctgggtgatgggatgatctgtgcagcaaaccaccatggcacacgtttacctatgtaacaaacctgcacatcctgcacatgtaccccggaacttaaaataaaagttgaaa

SEQ ID NO: 350 - DNA, 3075 bp, Homo sapiens
  repeat_region (1)..(3075): l1pa12_5
  misc_feature (70)..(70): n is a, c, g or t
  misc_feature (70)..(70): n is a, c, g or t
  misc_feature (982)..(982): n is a, c, g or t
  misc_feature (1387)..(1387): n is a, c, g or t
  misc_feature (1380)..(1380): n is a, c, g or t
  misc_feature (1123)..(1123): n is a, c, g or t
  misc_feature (1256)..(1256): n is a, c, g or t
  misc_feature (1322)..(1322): n is a, c, g or t
  misc_feature (1329)..(1329): n is a, c, g or t
  misc_feature (1353)..(1353): n is a, c, g or t
  misc_feature (1450)..(1450): n is a, c, g or t
  misc_feature (1505)..(1505): n is a, c, g or t
  misc_feature (1517)..(1518): n is a, c, g or t
  misc_feature (1659)..(1659): n is a, c, g or t
  misc_feature (1851)..(1851): n is a, c, g or t
  misc_feature (2093)..(2093): n is a, c, g or t
  misc_feature (2103)..(2103): n is a, c, g or t
  misc_feature (2140)..(2140): n is a, c, g or t
  misc_feature (2149)..(2149): n is a, c, g or t
  misc_feature (2179)..(2179): n is a, c, g or t
  misc_feature (2189)..(2189): n is a, c, g or t
  misc_feature (2245)..(2246): n is a, c, g or t
  misc_feature (2248)..(2248): n is a, c, g or t
  misc_feature (2254)..(2254): n is a, c, g or t
  misc_feature (2438)..(2438): n is a, c, g or t
  misc_feature (2446)..(2446): n is a, c, g or t
  misc_feature (2521)..(2521): n is a, c, g or t
  misc_feature (2113)..(2113): n is a, c, g or t
ggaggtggccaagatggccgactagaagcagctagtgtgtgccgctctcatggagagaaatggaaggggngagtaaatacagcaccttcaactgaaacatccaggtacacgcattgggactaatcaagaaaacaacttgacccatggagaacggagaaaagcaaggcaggacgacggcccacccgggagcgacacggagccaggggagcctcccccgcccagggaagtggtgagtgaatgtgcggccccgggaacccacgcttctcccacggatctttgcaaccctcaggtcaggagatcccctcgtgaacccactccaccagggccttcagtctgacacacagagctatgtggagtctcggcagagcagccgctcaggcatgcgtggagaccctggagccttagatacccgggcttcccggcaaaagtagctgcaactccagcaaagcgggaggttagacccccatacatacccctaggaaagaggctgaatccagggggccgagcagtgayagtctgcaggccccacttccacrgcacctcacaggataagacccactgacttggaatttcagcyagccacyggtagcagcgttgcacctmcctgraacrgagctcccagggggaaggggcgggctgccatctttgctgtttgggcgacttagccattccagccttcgggctttggagagtccaagccaactaggggcagaagsgatcccccagcacagmmcagcwgctctaccaaaacrtggccagactgcttctttaagtgggtccccgatcctattcctcctcgctgggcgggacctcccaaccggggcctccagccacccccgctggtgttytctagccgacagagatttgtaattctccctgggacggagttcccagagggaagggcgggccaccatctttgctgtttgrgcggctcagccgttccaaccttcgggctttggagagcccaagctgaccgggggcngaaggaatcccccagcacagcacagctgctctaccaaaamgcggccagactgcttctttaakcgagtccccgatcccatttctcctcactgggcgggacctcccaaaccgggtctccagccacctcctgcakgtgttctcnggctaacagagatttgaaccyccctgggacgragctyycagagggaggggcaggcygccatctttgctgtttsrkarmcttmrctgttsawaccttcaggcwytggaraattyaaggcgacyagggkctrgancggacccccagcacagyacagcwgcyctaysraaawgtggccagactttttkttaagtaggtcccnaatcccntwtctcctcactgggtgggacctnccaaccagggtctccagccacctcctncaggtgnttttgggctggcaacaggtccgtacctccctgggacgaagctcccagaggcaggggcaggctnccatcttcgctgtttcgtagccttcactggtgatacctccaggtactagaaaatncgaggtgactanngactggagcgggcccccagcatattrcagcagccctacggaaaagtggccagactgttatgtgggtscctawtcccatatctcctcactgggcgggtcctccaggcctgggtctccagccaccacyyaccggggctgtcgngccagtaccarctcwgcaactccctggacagagccyccaggggaaactgaaagcctctctgccactgcctctgcagtggaactgcccttgctaccctcagactaacgaaggagsaaagaccctaagtgccttatccacacctccaacaagctgcagtcgacccaaggagaggaggccagtctgtctcycacnggtcccacmcaccccccacwgcttgtcaccasrcaggraacccctggcttgggcccacagcacagaccctccatcctgggctgactgcactgagcgattgctgacctgcatctctctggggtggagcccccaggagacaagcaaaagaccctcggccacaaccactactaaggtcccttcctccgckgcctccaagttggggagaaaacataaaccctgagatcaccccagagctgttatgngcagcccggnagtgccaagntacgatctacagccagcactcaagtgngagaggagnccacactttcatagcattgagagggaacanggctgcaaangtgaggaaatacaggggagccacacgactgagcaagagcctaccaactgaccactnnanctaagngtcacctactggatcacgccctaaagcttcaagaccaaaagtacttcacaaacatagccccctgtgaaacaagagacaggaagtaagcttcaaataaagaccatgcacaaagcctcagcccagtgaaaacatccaaaaaggaagtctattgattgtattcaatgcacactgcagttaaaggaanatccacanacagagatgagaaagaaccaacgcaagaactcgcgtaactcaaatggtcagagtgtcttatgtcctccaaacgantgcatagttttccaacaaaggttcttaactaggctgagttggcatgaatgacagaaatagaattcagaatatggataggaacaaagatcattgagattgaggagaatggcataacccaattcagggaaactaagaatcacaaaatcatgataaaacgatacaggagctgaaggacaaaatagctggtataagaatgaacctaacaaatacatctgatagagatgaaaaacacactacaagaatttcacaatgcaatcacaagtattaatagcagaataaagcaagctgaggaaagaatctcagaaattgacaactggctctctgaaataagacagtcagacaatcacaaagaaacaagaataaaaaggaatgaacaaaacatgcaagaaatatgggattatgtaaagaggccaaatgtatgaacgactggcatcactgaaaggatggaggagaaagcaaacaacttggaaaacgtatttcaggatatcgttcatgaaaacttccgcaaccttgctagaaaggccataagtcaaactcagaaaatatggaaaact

SEQ ID NO: 351 - DNA, 904 bp, Homo sapiens
  repeat_region (1)..(904): L1PA15
ctaatatccagaatstacaargaacttaaacaaatttacaagaaaaaaacaaamaaccccatcaaaaagtgggcaaaggacatgaacagacacttctcaaaagaagacatwtatgtggccaataagcacatgaaaaaaagctcaacatcactgatcattagagaaatgcaaatcaaaaccacaatgagataccatctcayrccagtcagaatggcaattattaaaaagtcaagaaacaacagatgctggygaggctgtggagaaataggaatgcttttacactgttggtgggaatgtaaattagttcaaccattgtggaagacagtgtggcgattcctcaaggatctagaaccagaaataccatttgacccagcaatcccattactgrgtatatacccaaaggaatataaatcattctattataaagacacatgcaygtgtatgttyattgcagcactattcacaatagcaaagacatggaatcaaccyaaatgcccatcaatgatagactggataaagaaaatgtggtacatatacaccatggaatactatgcagccataaaaaagaatgagatcatgtcctttgcaggaacatggatggagctggaggccattatccttagcaaactaaygcaggaacagaaaaccaaataccgcatgttctcacttataagtgggagctaaayattgagtacacatggacataaagaagggaacaacagacactggggcctacttgagggtggagggtgggaagagggagaggatcaaaaaactacctatcgggtactatgcttattacctgggtgatgaaataatctgtacaccaaaccccagcgacacgcaatttacctatataacaaacctgcacatgtaccccctgaatctaaaataaaagttaaaa

SEQ ID NO: 352 - DNA, 1992 bp, Homo sapiens
  repeat_region (1)..(1992): l1pa15_5
  misc_feature (760)..(760): n is a, c, g or t
  misc_feature (1149)..(1149): n is a, c, g or t
  misc_feature (1261)..(1261): n is a, c, g or t
  misc_feature (1418)..(1418): n is a, c, g or t
  misc_feature (1533)..(1533): n is a, c, g or t
  misc_feature (1558)..(1558): n is a, c, g or t
  misc_feature (1802)..(1802): n is a, c, g or t
aagatggctgactagatgcagccaggwggaacakctcccactgagggaccaggacatcaggaagactggcacactcctarcagatcttcagagggaaggcaytgagagtggacggagggaagacacagawgctgggctgaagggggaggaagctgggaaccctgcacggggctaccrmgcaccaggactcgttcctggcccccagtgactcctggggaakgggtgagttgaacaggcaaggagyracccactctcaccatggacctctggaatcctagcagsaggagaccccwcgaccmccayrgacacttgagytggcagggagagctgcttagagaagtggtaggggcagramtccagcctgtgtggagcccagagggtttggtgcaggarcatctgtagtggagcacggccagggaygcccatcccccaaggctcamcatgctcccataggagactttagcccttagggkaactgtyrgacctgaacwctgcagggtrgtcttgcccatgagacrgggccagtctgacctgagcaccccttggtctgctggcctctccyggggccccagcctggccacacctgcttgcagtgcagcctccaggtgcctcctgggggcccacatcatagcttctgcactggcagaccatgcctgaccagcagagagctccagcagggcggcccccatggmcacgcaccagcctgcatgctccctccccacactgcagcttccccatggygctttgcctgcacacattnrcccatggcaactccccacatcactttgctggcacgtgtctgcatrggtggrttttgctttccttgccctgccagygtacatgtgygagtgcaccctgctgtgccactgctgctggygggagtgcaccccccacccattctcccatacctsctgactgccattgcagatggagccttggtgggcacagagccagccagccccacccccaccagyrcccyrcccytgyrctaacactgcccctggagtgaaaccaggcacaagaacagcggatyctccccyaccctgagcgaccactcctgcttgtggggcacagagaaggcacacagacctcacmcagwyctgwgccgaccagcgcttcgccccgtgctaacaccaccwccggtgcaancgcawgcacagwcgccggcgrcggcccctcgccgctctgagccgttctgccwctgctgccgctgtgaatgcscacagggaggcaggcacccccgcacccgctagtacccccnacccccacctaaggcgttgagcgygcaccctgccgtgccgccgctgctgctggcacacgcaagcaagcatagatcctgctgccaccgccccaaaaaagcactttggctggcaccacccatcggagtgttgtggccagtggaccgggaacacctcggncccyccagcgcagcaggttcctaacctcgaggggccagagaacaaagctggggacccgrtaccagccccccagagttagagcacacagcccaggagtgctgagctgagccttggncccctaaaatcttccagaaacgaanccagtcaactgaacccaccttataccacaatcaaacccccaagggcatcaaagaagatraaagaaaaaaaaaycatccaaaggacagcaacttcaaagattgaaggaacatcagcccacamagatgagaaagaaccagtgcaagaactctgrcaactcaaaaagccagartgycttctttcctscaaatgactgcaytasttcyycagcaakggttcktaactaggctgaaatggctgaaatgncagaaatggaattcagaatatggataggaatgaagatcatcaagattcaggagaamgtcgaaacccaatccaaggaakctaaggaatcacaataaaacgatayaggagctgamagacaaaatggccaktwtaraaaagaaccwaactgatytgatagagctgaaaaacwcgctacgagaatttcataata

SEQ ID NO: 353 - DNA, 1884 bp, Homo sapiens
  repeat_region (1)..(1884): l1pa15_5
  misc_feature (60)..(60): n is a, c, g or t
  misc_feature (164)..(164): n is a, c, g or t
  misc_feature (1376)..(1376): n is a, c, g or t
  misc_feature (1381)..(1381): n is a, c, g or t
  misc_feature (1428)..(1428): n is a, c, g or t
  misc_feature (1695)..(1695): n is a, c, g or t
  misc_feature (1729)..(1729): n is a, c, g or t
  misc_feature (1763)..(1763): n is a, c, g or t
tttttttcccaagatggcggattagaggcttttagtatgcctcagccacttggaaatggnaaaatagtgcataaagatcaactctgtgagctttaattcaagaaggaaaatgggaatccaccataatcgtgaaggacaccccagatcctagggaggagaatgtnggcaaacagcccctatgatggcgtccagctgataaaagtgagtgaagccccagtacgcgagagaggcagagagtctccctctgtgactcacttttccactggggatccgagcaacccaggccaagggagaacactttgtttctcccaagccctggagctaacgtggggagaggcttggagatgctgtgagggaaagacaccgggaaaagctgcagacattttcccagacctaggamcaagagcaggatgccatttttaatccgggcgcatacaaagtcagccattctttggcgacccggcagcgtggccgcgcaggcattttagtctcaggccagagattggagcgcctgctctggagtagggtaggggcctccacagccagaactgtgaaaagcgcctcagcagtaggcgctggaattgtgctctcccctactgcaagcctggggcgggaggagagctgctacagctgcagtttctcctgggcggcgagacttgcagccagggccagcttggcgacctggaactggtctgtgtgtgccattgctgggtgccccagcctgctcccctgagatcgtggtgcagsggggccctctctgctccacgcccaggcagatctccaggcattcagagcacccgctcgcctggwtcagcagcctgagccgccccacccttcctgkgcatagatcgtggtgcagsggggccctctctgctccacgcccaggcagatctccaggcattcagagcacccgctcgcctggwtcagcagcctgagccgccccacccttcctgkgcatagatcgtggtgcagsggggccctctctgctccacgcccaggcagatctccaggcattcagagcacccgctcgcctggwtcagcagcctgagccgccccacccttcctgkgcatagatcgtggtgcagsggggccctctctgctccacgcccaggcagatctccaggcatctggagcacccactctcctggattaggagtttaagccgccccacccttcccgtgcagagaacttggggctgaggaggtttccctgctccacgcctaggcacacctctgggcgcttggtggctgcccactggattctcccttggcgctggcgcttgtgcccgccatcgggagatctgtaggcggacctgcctagtccggccccacccatcttggmccccgcccctccagggctgagcagrsagttcagancactntgcattccatgcatcagcccattkcctgaggcaacagagagcttctnccagtaaacaaggatcaaatatatacccagccacactggccgtagctagctcttacctataagcgccatctactggcttgtaggtcaaactgcacwgcccaatataaaacctgctaaaagaagtgcatagggctatagaagcaaagccaaaagaccatacccagcattctctacagtcacaccmcctagggaggaggagaaaggaaagggaaagaaaaaacaccaataatattatagggaaagaaagaaaagaaaaaaccctactcncatggaaataattacaaaaattagaagtgccagnatctccagatgagaaggaaccagcacaagaattntggcaccatgaaaaatctgaatgtagtgacaccaccaaaggatcgcactagctctccagcaatggttcctaatcaaaacggaaactcagaaatgacaggcaaagaattcaaagcatggatt

SEQ ID NO: 354 - DNA, 893 bp, Homo sapiens
  repeat_region (1)..(893): l1pa2
ctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgtggtggggtggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataataaaa

SEQ ID NO: 355 - DNA, 892 bp, Homo sapiens
  repeat_region (1)..(892): l1pa7
ctaatatccagaatctacaaggaacttaaacaaatttacaagaaaaaaacaaacaaccccatcaaaaagtgggcaaaggatatgaacagacacttctcaaaagaagacatttatgyagccaacaaacayatgaaaaaaagctcatcatcactggtcattagagaaatgcaaatcaaaaccacaatgagataccatctcaygccagttagaatggcgatcattaaaaagtcaggaaacaacagatgctggagaggatgtggagaaataggaatgcttttacactgttggtgggagtgtaaattagttcaaccattgtggaagacagtgtggcgattcctcaaggatctagaaccagaaataccatttgacccagcaatcccattactgggtatatacccaaaggattataaatcattctrctataaagacacatgcacacgtatgtttattgcagcactattcacaatagcaaagacttggaaccaacccaaatgcccatcaatgatagactggataaagaaaatgtggcacatatacaccatggaatactatgcagccataaaaaaggatgagttcatgtcctttgcagggacatggatgaagctggaaaccatcattctcagcaaactaacacaggaacagaaaaccaaacaccgcatgttctcactcataagtgggagttgaacaatgagaacacatggacacagggaggggaacatcacacaccggggcctgtcggggggtggggggctaggggagggatagcattaggagaaatacctaatgtagatgacgggttgatgggtgcagcaaaccaccatggcacatgtatacctatgtaacaaacctgcacgttctgcacatgtatcccagaacttaaagtataataata

SEQ ID NO: 356 - DNA, 606 bp, Homo sapiens
  repeat_region (1)..(606): l1paxx_5
  misc_feature (523)..(523): n is a, c, g or t
ggggtggggccaagatggctgactagaagcagcwgcgatcggaggctcccatggaaaagaaccaaaacagtgtgtaaatcctgcaccagcaactgaggtatccaggttctctcatcaggactgactaggcagctggcatgacccatggagaggaaggaagagcagtgtggtgtggcggcccacctgagagccacacggggcaggggagcccccaccccccagccaagggaggcagtgagtgagcatgctacccagcctgggaaaccgtgctttttccacggaactgtgcaacccatggatcrgaagatcccactcrtgaacccacrccaccagggcctagsgtcccaaccccggagctgtgcagattctcaacagcctctcagctggaatctgcttaagcctaccgagctcccggggggaggggcgaccagcaccacagctgcagctgcctgctgtctaagccatttgagctccttgggggaggggcagcagccagcactgggactcacaactgcctaacacnctaagctccctgggcaggggaagggcagcatccatctctatagctccaggctgtgcttttcccctgctggagccagggaggct

SEQ ID NO: 357 - DNA, 902 bp, Homo sapiens
  repeat_region (1)..(902): l1pb1
ctaatatccagaatctataaggaactcaaacaaatcagcaagaaaaaaacaaacaatcccatcaaaaagtgggctaaggacatgaayagacamttctcaaaagaagatatryaaatggccaacaagcatatgaaaaaatgctcaacatcactaattatcagggaaatgcaaatcaaaaccacaatgcrataccatcttactcctgcaagaatggccataattaaaaaatcaaaaaataatagatgttggcgtggatgtggtgaaaagggaacacttytacactgctggtgggaatgtaaactagtacaaccactatggaaaacagtatggagattycttaaagaactaaaagtagaactaccatttgatccagcaatcccactactgggtatctacccarargaaaakaagtcattataygaaaaagayacttgcacacrcatgtttatagcagcacaattyrcaattgcaaaaatatggaaccaacccaaatgcccatcaatcaayragtggataaagaaaatgtgrtatatatataccatggaatactackcagccataaaaaagaatgaaataatggcatttgcagcaacctggatggarytggagacyattattctaagtgaagtaactcaggaatggaaaaccaaacatyrtatgttctcacttataagtgggagctaagctatgaggatgcaaaggcgtaagaatgatacaatggactttggggactcgggagatcgggrgaaagggtgggaggggggtgagggataaaagactacaaattgggtacagtgtacactgctcgggtgatgggtgcaccaaaatctcacaaatcaccactaaagaacttattcatgtaaccaaacaccacctgttccccaaaaacctattgaaataaa

SEQ ID NO: 358 - DNA, 897 bp, Homo sapiens
  repeat_region (1)..(897): l1pb3
ctaatatccagaatctataaggaactcaaacaaatcagcaagaaaaaaacaaacaatcccatcaaaaagtgggctaaggacatgaayagacamttctcaaaagaagatatryaaatggccaacaagcatatgaaaaaatgctcaacatcactaattatcagggaaatgcaaatcaaaaccacaatgcrataccatcttactcctgcaagaatggccataattaaaaaatcaaaaaataatagatgttggcgtggatgtggtgaaaagggaacacttytacactgctggtgggaatgtaaactagtacaaccactatggaaaacagtatggagattycttaaagaactaaaagtagaactaccatttgatccagcaatcccactactgggtatctacccarargaaaakaagtcattataygaaaaagayacttgcacacrcatgtttatagcagcacaattyrcaattgcaaaaatatggaaccaacccaaatgcccatcaatcaayragtggataaagaaaatgtgrtatatatataccatggaatactackcagccataaaaaagaatgaaataatggcatttgcagcaacctggatggarytggagacyattattctaagtgaagtaactcaggaatggaaaaccaaacatyrtatgttctcacttataagtgggagctaagctatgggtatatacgggcatatagagtggtataatagacaytggagactcaaaaggtggagggtaggagaggggtgagggatgaaaaattacctattgggtacaatgtwcactattcgggtgatgggtacactaaaagcccagacttcaccactayacaatatatccatgtaacaaaaakgcacytgtaccccctaaatytataaaaataaa

SEQ ID NO: 359 - DNA, 2247 bp, Homo sapiens
  repeat_region (1)..(2247): l1pba_5
  misc_feature (6)..(6): n is a, c, g or t
  misc_feature (764)..(764): n is a, c, g or t
  misc_feature (1819)..(1819): n is a, c, g or t
  misc_feature (1835)..(1835): n is a, c, g or t
  misc_feature (1839)..(1839): n is a, c, g or t
  misc_feature (1880)..(1880): n is a, c, g or t
  misc_feature (1972)..(1973): n is a, c, g or t
  misc_feature (2136)..(2136): n is a, c, g or t
  misc_feature (2173)..(2173): n is a, c, g or t
acaaantagggaaaaatggcggataggaggcaggactaaattgcagctcccactcggatggacagagcagcatgtggagactcacatcgtgaacttttgctccaagaaccaccgcaggaatataycaagaaagccgagagaatycacagaccctctgaaggaagcagattgctcctgcargayccaggaaacggcccaaaaactgtgagtgcccaaagtgtgagaagggraaaatctgcccccgaacacacatcctyactggggaacctgaagatccagatcacaggagaaggatttgaccttacctggagctgagacaatttagagggccgagcaaaatacaggggtagaggaagcagtgggaaaagccctgtgggctctccgggtccccagggaagccatttctgactttgtctcacaggggtccctggggagggctgccagwggaactggggaaaggccacagggagaaggaaacctccagctgaactttgtaacaattccgaccgaacgcgaagtttcctggccagaactcaggggagggcgtgaatccggwgtgcagactcagcacagaagccgtggcaggcaggaggcgcgaagcctgaaagccctgcttgctttctcagcwgggaggctggtagcctggggcaagttctcagccctgctcaccaactgcctggaaataaactcggtgctgttgtgggggggcacggtgggagtgagaccggccttttkggttgcatgggagctgggtgaggcctgtnactgccagctttcccccacttccctggcgacctgcatgacacagcagaggcagccataatccccctgggaacgtaactccattggcctgggaactacacccccatccctcacagtagccgcagcaagccccgcccaaggagactctgagctcagacatgcctaaccctgcccccacctgatggtctttctctacccaccctggtagccgaagacaaaagacataawctcttgggagctctayggccccacccatcgcctgagaaacwgaaatayttaycywggcmamcttagggcaagcttrtatccwccctatactrtcgcagctgatgccctcttgaaagcgccacctcttggctggaggccaaccaactcaagacattacagcaaytcayracagaataaccctgcccctarrraaggagaaaacgacagctatcaccactgcctgcaacatcctggctaaccagaggtcctgagtctgtccacgtgayaasttcactrctakyataaccagcattcgagaaarccagcacactaagtctatctacaaccaaggaatctcacagagtctayttcactcccctgccacctccatcagagctggtgctggtattcaccgctgrgagacttgaagacaggtcacatcacwggatycyttgcagacattccccagyaccagcccggagtctggtagctccactgggtggctagayccagaagagcaataacgatcactgyagtccggctctcaggaagtcccattcctaggrgaagggggagagcaccacatcaagggaacaccctgtgggacaaaagaatctgaacggcagsccttgagtcccagatcttycctctgacatagcctacccaaatgagaaggaaccagaaaaayaattctggtaatatgacaaaacaaggttctttaacacccccaaaaratcacactagctcaccagcaatggatccaaaccaagaagaaatcyctgaattgccagaaaaagaattcagaaggtcgattattaagctactcaaggaggcaccgaggaaggtgaanaccaacttaaagaaanttanaatataatacaggatatgaatgraraaatctycagwgaaanagatagcataaakaaaaaacaatcamaacttcwggaaatcgaagyacacttatagaaatgcgaaatgcwctggaaagtctcarcaatagaatngaacaagcagaagaaagaacttcagagctcgaagacaaggytttcaaattaacccaatccgacaaagacaaagaaaaaagaataagaaaatatgaacaaagcctccaagaagtctgggattatgttaaacgaccaaacctaagaataatcggcgttcctgagnaagaagagaaatctaaaagtttggaaaacttattcgnggaaataatcgaggaaaacttccccgrcsttgctaragayctagayatccaamtacaaagaagctcwawraaca

SEQ ID NO: 360 - DNA, 945 bp, Homo sapiens
  repeat_region (1)..(945): l1pbb_5
  misc_feature (227)..(227): n is a, c, g or t
kggtgggaagtttctttcagcagaggcacagktgcagtgctgggctcagtggggaaagtctgcgcctctaccccaacagtcaggcagccctggtgmttgtgaagggtcttggagaagggattccttctccccctcacccaccactgcagacacagctggggcttctcccacaggaackcagcatgggtgcacctatagacagcctttctggaacaattcagggtgantgcatccccacaggaggagcgccctccaggttcaggcttgcacgagaggcagagtcacaattcctctctacttggaacatcaacattcctgcagatgaaaagaggtgcctgtctgatctgaatagctggaacactgggacaggagtgwggctgkgaggtggatmgctttcctgctggcctggcaggggagctgaggtggctcccacccttcmccctgaaaaaacctcagcgcatctmactgagagctcccccagccaccyccgtcaaggctgggacctctgcccaccattgggtattaaatctacccacctgctttagccacarctggtkyytacccakggayacctcccttactggcctgaagcctgaaccgtcaacccagtaaataaaatactggggaaaaattaaataaataaataaataaagtgcacaccactggggaacgagataagcttcaagagacctctgccattccaaccccacaggagacagtgaacycgctcacacaccaagcacattactactacaaccagcatctgagaaagccakcacacaaagactctctataaccaaggaactcatacagagtcttcacccctgaaagcacccagaaccaaattaggctacaataaactatawwcattaaagtcacatcctcaaggggaaaaaaaattaaaaagcacagtccaatcaaaaataaattcaaaaataattwgaa

SEQ ID NO: 361 - DNA, 527 bp, Homo sapiens
  repeat_region (1)..(527): l3
  misc_feature (498)..(498): n is a, c, g or t
attatattcagttctgggtatcacattttaagagagacattgacaaactggaacatgtccagagaagagtgaccagaatggtaaagggtctgaaaaccatgtcatatgagaaatagttgaaggaactggggatatttagcctggaaaagagaataggggagacttagagggagacatgatagctgtcttcaaatatttgaagggctgtcatatggaagaggaattagacttattcttgtgcagctccagaggacagaacaaggaccaatgggtggaagttacagggaggcagatttcagctcaatataaggaagaactttctaacagtcagagctgtccaaaaatggaatgggctgccttgggaggtagtgagctccctgtcactggaggtattcaagcagaggctggatgaccacttggcagggatgttgtaaaagggatttctgcattggatgggggattggactagatgacctttaaaggtctcttccaactctntgagattctatgattctatctttcaggga

SEQ ID NO: 362 - DNA, 2750 bp, Homo sapiens
  repeat_region (1)..(2750): line2
  misc_feature (17)..(17): n is a, c, g or t
  misc_feature (89)..(89): n is a, c, g or t
  misc_feature (116)..(116): n is a, c, g or t
  misc_feature (433)..(433): n is a, c, g or t
  misc_feature (500)..(500): n is a, c, g or t
  misc_feature (548)..(548): n is a, c, g or t
  misc_feature (578)..(578): n is a, c, g or t
  misc_feature (604)..(604): n is a, c, g or t
  misc_feature (709)..(709): n is a, c, g or t
  misc_feature (772)..(772): n is a, c, g or t
  misc_feature (797)..(797): n is a, c, g or t
  misc_feature (1117)..(1118): n is a, c, g or t
  misc_feature (2099)..(2099): n is a, c, g or t
ctgtcattcattaccgntccttgttgcagtcatccatcgagcccggctcggtcactccctctcatttctcgaagaktttrtctcctagntcaactgtcactctctcataataatantcctgtcataattcttggtgatttcaatatccacatagacgatccatccaatactctggcctctcagttccttgacctcctctctcccgtggtcttgttctcctctacccactctcagccactcactcccatggtcataccctagatcttgtcattactaataactgcaactcctccataatctcaatttcaagcatccyactcttttaccacyacctcctatctttctagctcactctctctggtgccctaactccaataatyctttgaccccaccgagacctmcaatccattgatctcatatgcttttcactgtnccgtgtcctcttccctcctttcwttgctcagattccatggtcaatcattataatcactcccwtacanataccctcaactcccttgcccctytctcmctttgtcttacttrcttgncaaaaccacaaccctggttaaatccaactntccgactaatttrcgcctgcacccgngcagctaaacatggctgragaaaaatacacaaccatgctgactggtctcactttaaatttatgaccacgaacctcaagtgrgcccttaatgctgccaggcaattntactacatttccctagtccattcactctcccactctcctagatgactatttyatactttcttnyttctcaaacctccaacayyyyytnccatctttactctcagctgatgaccttgcttcctatttcactgagaaaatagaagcaatcagaagagaatttccacatgctcccaccaccacatctacccacctacctgcatctgtacccatatactctgccttccctcctgttaccgtggatgaactgtccgtgctcctatctaargccaacccctccacttgtgcactagatcccatcccctcttgcctactcaaggacgttgctccagcaattctcccctctctctcctgcatcatcaatttttccctctctactggatcattcccatcagcatataaacatgctgnnatttctcccatctttaaaaaacaaaaattctccctcgaccccacttccccctccagctaccgccctatttctctgctcccctttacagcaaaacttctcagaagagttgtctatactcgttgtctccacttcctcacctcccgttctctcttaaacccactccaatcaggctttcgtccctaccactccactgaaactgctcttgtcaaggtcaccaatgacctccacgttgccaaatccagtggtcagttctcagtcttcatcttacttgacctctcagcagcatttgacacagttgatcactccctccttcttgaaacactttcttcacttggcttccaggacaccacactctcttggttttcctcctacctcactggccgttccttctcagtctcctttgctggytcctcctcatctccccgatctctaaatattggagtgccccagggctcagtccttggacctcttctcttctctatctacactcactccctgggtgatctcatccagtcycatggctttaaataccatctatacgctgatgactcccaaatttatatctccagcccagacctctcccctgaaytccagactcctatatccaactgcctactcgacatttccatttggatgtctaacagrcatctcaaayttaacatgtccaaaactgaactcctgattttcccccccaaacctgctyctcccgcagtcttycccatctcagttaatggcaactccatccttccagttgctcargccaaaaaccttggagtcatccttgattcctctctttctctcacaccccacatccaatcyatcagcaaatcctgttggctctaccttcaaaatatatccagaatccgaccacttctcaccatctccactgcyaccaccctggtccaagccaccatcatctctcacctggactactgcaatagcctcctaactggtctccctgctyccacccttgcccccctncagtctgttctcagcacagcagccagaatgatccttttaaaatgtaaatcagatcatgtcactccyctgctcaaaacccttcaatggcttcccgtttcactcagagtaaaakccaaagtccttaccgtggcctacaaggccctatatgatctggcccccgcytayctctctaacctcatcttctaccactttccccctcgctcactctgctccagccacactggcctccttgctgttcctcgaacacgccargcwcgttcctgcctcagggcctttgcacttgctgttccctctgcctggaacgctcttcccccagatatccacgtggctcactccytcacctcmttcaggtctctgctcagatgtcacctyctcagagaggccttccctgaccaccctatctaaaatagcacacccyctcccccatcatgcccatytttcttaccycgctttatttttctycatagcacttatcaccatctgacayactatatwatttayttgtttgtttgtttrttgtctcctccacyagaatgtaagctccatgagggcagggattttgtctgttttgttcactgctgtatccccagcgcctagaacagtgcctggcacatagtaggcgctcaataaatatttgttgaatgaatgaat

SEQ ID NO: 363 - DNA, 419 bp, Homo sapiens
  repeat_region (1)..(419): line2b
  misc_feature (132)..(132): n is a, c, g or t
  misc_feature (279)..(279): n is a, c, g or t
  misc_feature (283)..(283): n is a, c, g or t
tcccccttgctcactctgctccagccacactggcctccttgctgttcctcaaacacgccaggctctttcccgcctctgggcctttgcacatgctgttcyctctgcctggaacgcccttccccwctccttcancctggccaactcctactcgtccttcaggkctcagctcaratgtcacctcctccaggaagccttccctgacttcccaggccgagttaggtgccctcctctgggcccccccggtcctaccctgccactctgggttatmattgtctgtkngcangtctgtctcccccactggactgtgagctccgcgagggcagggactgtgtctgtcttgttcaccactgtatccccagcgcctagcacagtgcctggcacatagcaggcgctcagtaaatgtttgttgaatgaatgaa

SEQ ID NO: 364 - DNA, 1460 bp, Homo sapiens
  repeat_region (1)..(1460): looper
  misc_feature (25)..(25): n is a, c, g or t
  misc_feature (27)..(31): n is a, c, g or t
  misc_feature (80)..(80): n is a, c, g or t
  misc_feature (82)..(82): n is a, c, g or t
  misc_feature (109)..(109): n is a, c, g or t
  misc_feature (113)..(113): n is a, c, g or t
  misc_feature (123)..(123): n is a, c, g or t
  misc_feature (128)..(128): n is a, c, g or t
  misc_feature (130)..(131): n is a, c, g or t
  misc_feature (136)..(136): n is a, c, g or t
  misc_feature (140)..(140): n is a, c, g or t
  misc_feature (145)..(146): n is a, c, g or t
  misc_feature (151)..(152): n is a, c, g or t
  misc_feature (158)..(158): n is a, c, g or t
  misc_feature (164)..(164): n is a, c, g or t
  misc_feature (169)..(169): n is a, c, g or t
  misc_feature (200)..(200): n is a, c, g or t
  misc_feature (247)..(247): n is a, c, g or t
ccttyagaayaycatcaggtcttgnannnnnttttatttttgagtttttahttgtaactatttdtaaggatattttatgncntttattctttcaaagaacwrargaaanatgnctgaataaanctcantnnagctngtanttaannatagnntgaganatcttnatgancctattttttccattttgctatttyatcttnctaggaattatttcatcattactaatcaattatttctaactgtgctnwtataaaaagactaaaataataagaaaatggaagaatgataaaacctcctgggatgaaataaataaatcatcactatgacatcatccttcagttttcttactgtgttgcccaaagtattgcattatctttcaagaaggtataaaagaagtctggagacaccatctttgtagtctttttttagctttcattgaacacagtcgagaattcagaatttttcattttctacccataatggcaaagagaaaaaaattgacagaggaagacatttcacaattattagatgaatcagaagatgaatgcaaagagacagatagcagcactctagactctaatgatgatggtgaaattgatcatataagtgaaatctcagactatgagtcttcagatgacgatatcctagatgaattttctcaaactcaagaatcgacgagtgaacaatatatttctaaggacaaaaaggaaatatggtattctcatccagttagtcattcaacaggaaggacttcatcacgcaatattttgcgacaagaacctggaccatcccattttgctaaaaggacatgtgacagtattctttcatcttttatgatgtttgtgcaccaaatttacttgatacagtttgtaagtggacaaatgctaaaggcaggtatgtttacaaaaggtaactggaaggaaatagatgaagagaaaaaaaaaatcattgaattgatcattctaattggtgtttataaatctaaaaatgaaaatgttttgcagttatggagcaaagaagatgtctctcttcaacaaaattatgagccctcaaaattttcaaaagtattacgttttgacgatgtaagtatggaagaaaagaccagaaataataataagctagaacctattagagatgtatttgaaatctggaatcagtatttacaagatagatatgttccaggttcatgcatgacagttgatgagcagttagttgcattcaaaggatattgcccatttcggatatatataccttcaaaaccaggaaaatacggaataaagaatggaattacaattttgggttataattcaaattaaaatttttaatgaagtttttttacaattccttaattcttcttctgtaaattattcgtaaaatgacttaaaaataaaaaaataaaaagagttcattggacccagatggtaaatggtgatgactgtttttccttggtgtaccgaggg

SEQ ID NO: 365 - DNA, 495 bp, Homo sapiens
  repeat_region (1)..(495): lor1
  misc_feature (134)..(134): n is a, c, g or t
  misc_feature (342)..(342): n is a, c, g or t
tgaaaccgrcccaattgtcccatagaactgatgtttatrgtttttttgaataaacatagaaattgaccctcctggtcttaaarcttgaaacttacatttgtyttatctgagttccttcctcaggaaaccaacyntcaggcctcycaaawagtatcaargaactgaaactcaccagatcacyrcatccagacaatgagayrccagacccctcatycatcatgattgcctaactgaccacctgctkcctgttgaccaactcctcttccttacccctccctaattcctgttttcyyacacatagttacatttcttccctgctatataaaccccyaattttagtyngtcagggagatggatttgagactgatctcccatctcctcggctgcagcaccyrawtaaagccttcttccttggcaatamtyrttgtctcagtgattggctttctgtgcagtgagcagcaggacctagacyraacccctggtrtttcagtaaca

SEQ ID NO: 366 - DNA, 491 bp, Homo sapiens
  repeat_region (1)..(491): lorli
gattttggttccctgaccgggaacgcattgctcgtggctcggctgctgtgggccgggagtttcagaagccctcctaagcagctgcccatcccatttttggccggaggtgagtttctgtttctctttggccccgccgctgccagccccaacagtgttcctgattgcctaggaagaacagtctttgaaatttgacatctgcgtctagatggatgagtgtcttttgtgggtaccagacagcgggatctgctcctctcaatttgggaaattctgaaggaatttccgtttgcaggttgaacaagcccaaccgactgagagaggaagcaccccgactgtttcagtttggacactcttggggcttgtttgttgctgcagcagttggattgcgttttggtgattgtgtgcgtgtgtgtgtgtgtgtgtgtcaatatagtcacgggaaattagaatttgataaacggatattcttttataatactgtttggccccactat

SEQ ID NO: 367 - DNA, 498 bp, Homo sapiens
  repeat_region (1)..(498): lsau
cgtcggaaggtgttgggagagcctcagccggaatttcgtggacggacaagggcacagagagcccagcgggctcccttgcatgtcagccggggtgcacaatgagcacaggtctagccaggaggccggcaaagagagctagaggtctgcgttccgccgccaggctctccatggtggcagctgggaggatgcaggggcatgggcgggccggcgacgttgcacggagacgcagaggaggtgagtcactgggggggtgtcaggcctggacgctgtgcgggcccagtgttttcgcgggaagagggtctccacccagcccaggggaggagcgcattttcagggggttggtggtgaggctggggatggtgtgctcaggcaggggtgtgatggaggaaaggcaggagagctctgccctggtgctcccgctgcccaggcggctaacttgcaaacccgcgcatgtgcagaggcagctcacctgtgggtacctgggccggctctgggatc

SEQ ID NO: 368 - DNA, 785 bp, Homo sapiens
  repeat_region (1)..(785): ltrl
  misc_feature (297)..(297): n is a, c, g or t
tgatacggacaggrgrgggaartgctgggtagaggagggcgggktccctggctagggctccaccctcgggcctgtgcccacggacctaggtgaggacaggcatttytgttttcccgcccaaatgttgcatttyccaagaccacccytggcctgccacgccccccatcctgtgcctataaaaacccgagaccytagcrggcasasacacaagcggctggacgtcaagaggaacacaccggcggaagaacacactgacggtggcgccggcaggccatcgactggcggaacsattcgganttcggcaggggcggycggaggacagctggarracagccaggccgctgagcggccggactccaggggaaraycaccttcccactccatcycccttccggctcccccatctgctgagagctacttccactcaataaaaccttgcactcattctccaagcccacgtgtgatccgattcttccggtacatcaaggcaagaaaccccgggatacagaaagccctctgtccttgcgacaaggcagagggtctaactgagctggttaacacaagccgcctatagatggcaaactaaaagagcaccctgtaacacacgcccactggggcttcaggagctgtaaacattcacccctagacactgccgtggggtcggagccccacagcctgcccgtctgtatgctcccctagaggtttgagcagcggggcactgaagaagcgagccacacccccatcgcacgccctgtgagggggacaagggaacctttcccatttca

SEQ ID NO: 369 - DNA, 609 bp, Homo sapiens
  repeat_region (1)..(609): ltr10a
  misc_feature (63)..(63): n is a, c, g or t
  misc_feature (113)..(113): n is a, c, g or t
tgttaagtacggtgagttctgagatcctctccaaagaaccagtatgtcagtatgttcagctcncctgttctttgttctccattttaaagtttaacttcagtatgttcagctcncctgttctttgttctccattttaaagtttaactcaacagttctaatcagtagttaacgcctgttcccctggtcacctgctccatcctgactcatcccgggtcacctgctttgacctgagtcacccttagtcacctgctctgtaaccatccttcccgccaaactactcaccccgccactctggctcatacccctgctctctttaaaatagccaatcggaattagcttagactgtgcggtccaaccctagccaataggggaacgacacagcagtaggggctacctgcatcaggaataagaaccccttcccctcccttgtccaggtgtgctctcgccattgctccatctgcgagacgcacccttctatagaagtaaaattgccttgctgagaaaattaaatttatgtttgagtgctatttcttttgcggcaccgaaacgaaaattaaatttatgtttgagtgctatttcttttgcggcaccgaaactttatttataaca

SEQ ID NO: 370 - DNA, 510 bp, Homo sapiens
  repeat_region (1)..(510): ltr10b
tgttaaatacagtaagaaattcttcttcaaaagtttagcctgcttaagtttccttgtcctttgtttcctgctttcaaggccagacttccttactctctgtgtttcccctaccctggtaaacaaccttcctgccagtccttacccatacagcccacattccacatctgctacccactctgtgatttacctctcccgtcgcaatagcctctcccaccaaaactgatcttcccgccttcccaccagtgcaaccacattcctgcactttgcaagttagccaaccgggttcggattgtgcagtccaactccagccaatggagtcaggacacagtagcagggacaagctgcgttagacataaaaacctctgctttcctttgtttagggtgctctcgtggcaaccagacttaccaggagctctattctgcaaaagtaaatttgccttgctgagagaccctttgtcctttggctcagtgttggttcttctttgcagcaccgagcatttgtttccaaca

SEQ ID NO: 371 - DNA, 586 bp, Homo sapiens
  repeat_region (1)..(586): ltr10c
tgtaaaaagtaaagtagaggttcctcttcaaagactttcctccccatctaattaggaataaatagtaacttctcttaaaagcaaaatttattcaaagacctgtgctaacattcttaaatatctgctagccataataaagaaatcaatgtactttatattcttagctcccacaatttagcctaaatatttgccctggcatgcttatactagtccaagcaagcattaggtcatagcctgttcctcttccttatttgaaggtgtttttacctttctcagcattccacaagttacttcctccttcctttgttctcctctgcctttgcctcttttaaaaagttctaagttgctagccaatcaggacaaatacagaatgtgaggtcctgttccagccaatagaaactggacacagcagtagggtggacgcgtcaggttataaatgaccctgtctcctttgttcagtgtactctcatggcaaaactgctggtgagtgtaccctttctgcagaaagtataaawatggccttgctgagaaaattaaatttatgttcaagtgctatttctttacagcaccacaagcatttcaaaca

SEQ ID NO: 372 - DNA, 513 bp, Homo sapiens
  repeat_region (1)..(513): ltr10d
tgtgggatatgatgaggtttctcttcaaataacctgatcaatcttttattctttaattcatagtacccccctccctycttttttcytttttctccttttttcctttttgcctttgttagatgcccaggcacgccacagtaccaggcgttatcaataccagctcacattcctttccttatttggaaaaaagactaactttctagctcattacagacaccccttcccctttcctctccgctttcttttacgtgcccaccttatctaaaaaaaaatcaaatgtttagccaaccgggattagtttagattgtatgacccaaccccagccaatggggaaagggtacaagggcaggacttgcatcaraaataaaggctctcgtgcccctttgttcaggtgtgctctcatggcgactggccaaggagaagcacccctctgcgcagaagtaaaattgctttgctaagaatcctttgttcgagtgttcaatttccttaggattttgagcgttattcctaaca

SEQ ID NO: 373 - DNA, 684 bp, Homo sapiens
  repeat_region (1)..(684): ltr11
tgtgtttctgcaggatgtacagccctcccagcacggtgctcgcttccctaatgccattccacagtatttgttgcagagaaggaaggcagcatgccaggacagatggagacaggactaatttggcctgaggtatgtaattttgaacttgagcctctctctgggactgtaaaactccaaatcaaagctaatctgagaatacatacatctgaaagatgattaggactgtaaacatctattaatattcaactctgatacaaagtacaagttgtttattcttaccacgcaaggccaaaaaaggggagaaaaaaaaaaaagcacacagcatatgcactggaaagtttcgcttattcaaaacagtatttgtcaagcacctccagtctggtgctgcaggggaaacaaagattaaacagccaggcggacactgctctgcttccaaggtgcttacggtcttaagaaggagacaagacatgtttataaatagccaaaatgcaacccagaaaaggctaaaaaacactgagagggagggagaaataaacgaagcaagaggtctccggaggaagagatgaatgaattagcctattaataactccgtcactgtaatcccaatgtaaagcaagaattccaaaccaggaaaggtcaaactgaagtatttgaggaacacaggcgtcgcctaagcccttcaca

SEQ ID NO: 374 - DNA, 877 bp, Homo sapiens
  repeat_region (1)..(877): ltr12
tgtatctagttaatctggtggggagttggagaatctttatgtctagctaagggattgtaaatacaccaatcagcactctgtatctagctcaaggtttgtaaacacaccaatcagaaccctgtgtctagctcagggtttgtgaatgcaccaatcagcactctgtatctagttaatctggtggggacttggagaatctttatgtctagctaagggattgtgaatgcaccaatcggcactctgtatctagctcaaggttgtaaatggaccaatcagcactctatgtctagctcagtgtttgtaaatacaccaatcgacactctatctagctaatctagtggggacgtggagaacttttgtgtctaactcagggatgtaaatgcaccaatcagaaccctgtcaaaatggaccaatagctctctgtaaaacagactgactttctgtaaaatggaccaatcagcaggatgtgggtggggccagataagagaagaaaagcaggctgcctgagccagcagtggcaacccgcttgggtccccttccacactgtggaagctttgttctttcgctctttgcaataaatcttgctgctgctcactctttgggtccacactgcctttatgagctgtaacactcaccgcgaaggtctgcagcttcatctgaagcagcgagacacgaacccaccaggaggaacaaacaactccgatgcgctgccttaagagctgtaacaccgcgaggtctcgagcttcactcctgagccagcaagaccacaaacccaccagaaggaagaaactcaggaaaacagccgaacatcagaaggaataaactctggacacaccacctttaagaactgtgacactcgctgcgagcgtctgtggcttca

SEQ ID NO: 375 - DNA, 1030 bp, Homo sapiens
  repeat_region (1)..(1030): ltr13
tgtgggccgcaagccagggagctgcccaggcaagagcctgaaggcacaagctgttccagtacagcaaagaaaataattagaataagaaaagttttactagagataggaaacggataggattatatctgactattattaatcattagtttgtagcatcactctttgttctattaccataatgatctctgttctattatgattaccttgggggaaaccaggccacacagagttaggagctgaagggccacagtgagaggtgaccagaagacgagagtgtgagccctcattcacgcccagagaagggccgctggagggctccttggcctagcggtaatgccagtgcctgggaaggccctggttacttagcaggccttggtctagcggtggccccagtgcctgggaaggcacccgttacttagcagacccggaaaggaatctccctctctccaggggagacagagaacgctccgctccaccacctcttgtgggaggtctgacattagccaggccgggccgagtcatccggaggctccaacgtctgtctccctgtgatgctgtgcttcagtggtcacgctccttgttcactttcatgttcagcctgtgcacctggctcctccttttaagttcttagaagacagcagtagcagaactagtaggagtaccacagtcttcgatctttctgataagtgcatagaagaaacgctgacgtttgctgtcctccctctccacctcggctaccacaaagggaaaggccccctgtccagtggacacgtgactcgcgtgacctatcgatcattggagatgactggcactccttaccctgcccccttgccttgactacaataaatagcagcgcctccaggcactcggggccactacctgtctgtctccgcgctttggtggcagtggtcccccgggcccagctgtctttcttcctatctctttgtcttctgtctttatctcttcgatctctcgtctccgcacacacgcgaagagaaaacccacagacccggtaggggtggaccctaca

SEQ ID NO: 376 - DNA, 548 bp, Homo sapiens
  repeat_region (1)..(548): ltr14
tgttgggaaaaggacttgtggggtgcctgtataaactggccataaaaatatgggacaataagttgtggaaagccacaagaggcctctgaggagaaaagcctcctaattgccacgctcagagcgagacctgctctctcttatctgtaaacactgtattcaaggagaaagaccctcctttgaagcattggaatgtggacagacgtgcaggctcctagttaagcccactcccactagctactctccgataagttaaagatatgctgtttgagcacaaaggagattcatttaaagcgcttctgctgtagattatgcctgtgacgcactgctaccctttcactgttttgccctgaacatctgcttcttagatctaagttattgtactcaataaatagtgtggagaccagagctctgagccttttgcagcctccattttgcaattggccccctggcctccactctttatgaactcttaacctgtctcttctcattcctttgtcaccaccagacttcaggtaccctacaggtggtgttgaggctggtccccaaca

SEQ ID NO: 377 - DNA, 344 bp, Homo sapiens
  repeat_region (1)..(344): ltr14a
tgggagaaaagctgagtgttgggagagaagctgaggcagggcttgcatgtctgctagacttgctggctccttgcttctagcactcccattatctcaagcagccatatgtttctcattcacttgatacactgtttcctttcaacccccacatcctcaccacctgtttctttgtttgagcaccaataaatagcgtgggctcccagagctcagggccttcgcagcctccacactcgcgatggccccctggtcccactttctctctcaaactgtctttttctcattcctttgactccgccggactttgtcgcccccacgacctggtgttgggtctgatcaccccaaca

SEQ ID NO: 378 - DNA, 608 bp, Homo sapiens
  repeat_region (1)..(608): ltr14b
tgggagaaaagctgagtgttgggaaaagctgaggcagggcttgcatgtctgacataatgtaaaagagtcttggaacatgtccggggtccagggtctaaaacccctcgtggcctttggaacaccaagctctgtgctaaagggtggaaggctaccctgacgcaccataatctaagcccagggcataaaacccctcgtggcttggatagaatccagggctcgtggcctctggaatgtgtctagacttgctggctccttgctccttgctctcccaggatcgattgtatcttgagttaaaagaacctgctctccattatctcaagtagcagaacatgttccatatgcctcaaaggaaatgctaaaccatcacagctgtagatcatgcgcttaatgcaacttgccctttcgacccccacattctcaccacctgtttctttgtttgatcaccaataaatagtctgggcttccagagctcggggcctttgcagcctccatacttagcgttggccccctggacccactttctctctcaaactgtcttttctcattcctttgactccgccggacttcgtcacccccacgacctggtgttgggtctgatcaccccaaca

SEQ ID NO: 379 - DNA, 587 bp, Homo sapiens
  repeat_region (1)..(587): ltr14c
tgtgggaaagagagtttctggggtgccagttgagttggtctcccctgtgtgagacacccatgggaagccatgggcggcctctgaggagaaaagtctccttattgccttcatgtctttatgccccgagagcataaccgctcagcggcattccacaggttgctcagggagataacactcccttgaagcagtggagtataatcaaacatcttggctcctcctgaaacccactcccacccgtttcagtcccgataagttaaagatcttaagtagtttagacacacgcctttgctcaaggaaattcacagaaaccgccactgctacacatcttatcgaatgactcacgagttctccttcactgattaatccttttcctcatcccttcctccccctcccatctgccctaagaacaaagagcttgtaaaccaataaattgggtggagcccaagagctctgggccgtgagcaagcctccgatgctctggtcccctggacccgccttttaaacgcttattctgtctctttctaactcctttgtctccgccggactcggggtacccactgggtggtgtggggctggtttccccaaca

SEQ ID NO: 380 - DNA, 493 bp, Homo sapiens
  repeat_region (1)..(493): ltr15
tggaacaggaattaaaagaaattaaagaatgcataagcaaaaactcaattgtatgtagggaaacccaattcctcctgaggaagagaaagaggtggagtcctttaaaaattcactgcctgtttttccgtctgtagctagtgagccttatctctccctttcccaggcattgtgaagaccctgtttctccagctgtgcagctgcatggtcactagacagataaactcaagttgtaaaacatgtttttccttgaaaagtaagaaatgatgtaatacatgtctcaactgaataactgtctttgtttctcacttctgtagtaagcttccccctgcacagatctcccctctcaccccatgaaatgcttaaaaggtaacctgactctttgttcagggctcagtcctttggatgttaatctgactgggctggtgcacctaaataatamatayatcctcctcaaccccatcggtctctctgattcctaaatcatccccaaaca

SEQ ID NO: 381 - DNA, 450 bp, Homo sapiens
  repeat_region (1)..(450): ltr16a
  misc_feature (58)..(58): n is a, c, g or t
  misc_feature (124)..(124): n is a, c, g or t
tgtgacggacatgraggtgcgctgcccagatcccccttcaagaacggaartyttattncccyagctgctgggagwgctgtcggcagacagccctcagctgtcagccccttcaggaattgcctcngctgaagagagccgcctcgcccaaggtcacgccccctccccggggcagcccacatccaatgactgrtcaatrtggaggtataaaggcccggccctctcgccccaactcgggacaactctgaagggccatyccagctccagagctccccgtggggtcggctgaggcctttgttgcgactgcattgcagcccaacttctccctctgcccaatcctgcttccttcccttcccttccacaggcgttgatcccaagggcgctccctaataaacctcctgcacgctaatctccatctcagagtctgcttcccggggaacccaacctgcaaca

SEQ ID NO: 382 - DNA, 457 bp, Homo sapiens
  repeat_region (1)..(457): ltr16a1
tgtagtagatgctgttggtgccctgcccaggtcccytttmtcgggctagtgcatccattccccagctgctgtgagtgttggctgctaatggctcacagctgcccccttctctggagaattgccctcagctaataggagttgcctcacctgggaggttaccccccaccgggcagcccacagccaatagactgactgatacaggggtacaaaagcctagcycccttgcctcaaggtgggacaactcactctgtggtgcaattcatgctccagagctccccatgggatcaggctgaggctagacttcagctgaaaccacatccttgcttagcttcttcccctgccctatcctgcttccctcactcccttacaagtttctcctgagagcactccctcaataaatcacttgcacaagaatccctgtctcaggctctgcttctagggaacccaacctaagaca

SEQ ID NO: 383 - DNA, 387 bp, Homo sapiens
  repeat_region (1)..(387): ltr16c
  misc_feature (41)..(41): n is a, c, g or t
tgcctgaggrctttctctggccastgaagccagmtttgtcngcccacgtggcaagccggaaatgctggggagttaacaccccttggaagcagccctcaaccaatgasagatggggagttggtggataaataccccagcttcctcacccctcagkgggataactctgaggtatgtgttctacactgtctcccagagtttcccagyrggaytgagccccagttgcccacagtggtaacttgmtaatatacaytttattggcttccttctctttcctgtctcacttccccacttccctacyagtgtttcctgggatcacctcccaaataaactacttgcactcaaatccttgtctcagggtctgcttctgggggaacccaaactaagaca

SEQ ID NO: 384 - DNA, 464 bp, Homo sapiens
  repeat_region (1)..(464): ltr16d
  misc_feature (182)..(182): n is a, c, g or t
  misc_feature (353)..(353): n is a, c, g or t
  misc_feature (391)..(391): n is a, c, g or t
tgtggtggccatgaaaatgtgcctctcagatctcctgctgcagggagcatagttgactgacggccccagctgctgtccyttggratccaccactgcgtttgcaccaaggccacgcttccctcaggctactcccagccagtgactgagcacggcaggggtgctaatgcaggcccgttcctgsnagatgcgggactcctccgacgggcaactttggctcgaggactcctcatcagcctggttgaaactttcttagaactgcactgcagtctgaggctcttcctacccaatccttcttccttccccctctcctttcacaggtgtcagacctgcatcatggtccgaagtctctcctngcccgctcctgctccctccccttttatctttcacaggntttcccctaataaatctcttgcacatttaaccctgtcttggcgtctgcttctcagaggacctgaactaacaca

SEQ ID NO: 385 - DNA, 780 bp, Homo sapiens
  rerpeat_region (1)..(780): ltr17
tgagagacaggactagctggatttcctaggccgactaagaatccctaagcctagctgggaaggtgaccgcttccacctttaaacacggggcttgcaacttagctcacacccgaccaatcaggtagtaaagagagctcactaaaatgctaattaggcaaaaacaggaggtaaagaaatagccaatcatctatcgcctgagagcacagcgggagggacaatgatcgggatataaacccaggcattcgagccggcaacggctaccctctttgggtcccctccctttgtatgggagctctgttttcactctattaaatcttgcaactgcactcttctggtccgtgtttgttacggctcgagctgagctttcgctcaccgtccaccactgctgtttgccgccgtcgcagacccgccgctgacttccatccctccggatccggcagggtgtccgctgtgctcctgatccagcgaggcgcccattgccgctcccgatcgggctaaaggcttgccattgttcctgcacggctaagtgcctgggttcgtcctaatcgagctgaacactagtcactgggttccacggttctcttccgtgacccacggcttctaatagagctataacactcaccgcatggcccaagattccattccttggaatccgtgaggccaagaaccccaggtcagagaacacgaggcttgccaccatcttggaagtggcccgccgccattttggaagcggcccgccaccatcttgggagctctgggagcaaggaacccccggtaaca

SEQ ID NO: 386 - DNA, 358 bp, Homo sapiens
  repeat_region (1)..(358): ltr18a
  misc_feature (353)..(353): n is a, c, g or t
tgtaaggaaaatggmtgtgctkyrgtcaaggaataggccaaggcagacatccggtscagcatgactcagtargtttggagtgcaggygcacaacyccackcattatgtaaccayrycdcatgarrcgcatakgtaatcacycacrtgagctcatacttggctcggagccactattgtctgtraaaggtataactgccctgctgacgctgtgcacatggctcgcwyccacccagagagagaataaagccatgtctcaactgcctacggtccctcgagtgttytttcagctacccgccacycatccacccactcccctcggacctcagcttaggctggaacctgacacttggctntgaca

SEQ ID NO: 387 - DNA, 603 bp, Homo sapiens
  repeat_region (1)..(603): ltr18b
tgtaaggtatatggatgtgctctggtcaaggaataggccaaggtggacatctgggccagaatgactcagtgagtttagggtgcaggcgcatactccacttgttatataacctgtttgtgtaagctcatactgggctcggagccactattgtttgagaaaggtataactgccctgctgacgccgtgcacagggctyktgcgggcgcgcccraagaaaagagagagagccagagttgtccatcttgtagacggacaagggggagccagggctcggctcgcttgccacccagagaaawgagttaagctgctaaccctgtaagggagagcctaccttgtaggccagggaatgcagctgtgtgtgggagtggcaggagctgcagagctggagcagacagccgagataaaggtagacagtgtgagagagctgctgcgagagagctgctgatgagagagctagtgtgagtgagctgctratgaaagagctgctgaataaarccatattcactgcctacrgycccyygagtgttctttcagctatttgtcgcccatccacccactcccttcggacctcagcataggctggaacctgaccctgggtgtgaca

SEQ ID NO: 388 - DNA, 486 bp, Homo sapiens
  repeat_region (1)..(486): ltr19a
tgacagagcaggagcatcgccatcttggacaagcactgccattttaaagttccccttgatcaaaaaccgcctaaatccaacccaaagggcatcagcctaatggctaakgtcagcatgaccataaaccacaaatgacatctccgaccagaaacattccaaccctaagataaacccctcccyraccagagacatgccagccccgagataacctcccctccggccagagagatgtcagccccaasataacctccccttcaaccagagacattccaaccccacaataaacttctcccccacacagaaacattccaagcctgtgataaagctctctcaccctaaaacccttaaatactcttagtctgtaagagagagtgctcctgactgaaatcggccagaagcccctctcaggtttattctccaaaataaacctgtctttgactgttgagccgcttttcrtgtttctttcctctttctttaactcttaca

SEQ ID NO: 389 - DNA, 580 bp, Homo sapiens
  repeat_region (1)..(580): ltr19b
tgacagagcaggagcaccatcatctcggacaaacactgccattttaagttccagctccttttccagcctyatgcatttcaaggaaatcactttycttctaactacaagcagccagaaagagcagacagtaaaatacagataagacagctcgggcacagagggaggtggkrggaaagtctcttgggtaactgccaaacttyaccctcatacaatgggccccagtaaaayagkgggccttaataagcacattcctttyccttcgggtwcactaagatarggaagctaaaagcagactcagggaggcggcggggggtatgcctgcagctgcakraagatrtatgggarcagacayacaaytstccctcccagataagcacaacaaagagacacagaagcagtccaagcctctrataaactctctcaccctgaatccttaaaaactcttagtctgtaagagagtgtgcctctgacctaactcggccagaagcccctctcaggttcgttttctctaaaataaacctgtctttgttgactgkwgagccgcttttcgtgtttctttcctctttctttaattcttaca

SEQ ID NO: 390 - DNA, 826 bp, Homo sapiens
  repeat_region (1)..(826): ltr1b
  misc_feature (200)..(201): n is a, c, g or t
  misc_feature (224)..(224): n is a, c, g or t
  misc_feature (245)..(245): n is a, c, g or t
  misc_feature (322)..(322): n is a, c, g or t
  misc_feature (336)..(336): n is a, c, g or t
  misc_feature (620)..(622): n is a, c, g or t
  misc_feature (763)..(763): n is a, c, g or t
  misc_feature (770)..(770): n is a, c, g or t
tgatatggacaggagacagggaaatactgggtagaagagggtggttccccagcaaaggccccaccctcaagcctggagacctgcggccctaaatgggaacaggcattcctgttttcacgcccaaaaagttgccttttggcccaccacaccccctatcctgtacccatataaaccccaaaccccaggctccagaagcagannagcagacaaggagaggagcagangaggagacgagcagaagagcngcagaatagtgcggcagagaagagaaggaacgtctgaacgccgagaggagttcrgctrgggrcrgtcagagargagntcagccgctggayngccaaactccaggggaagatcatcttcccactccatcccctttccagctccccatccatcccactgagagccacctccaccactcaataaaaccccygcattcaccatccttcaagtccatgtgtgacccgattcttctgggatgctagacaagagcttgggatacagaaagctgtcacactggccctctgcccttgcaaaaaggcagagggtccactgagctggttaacacttaagccatctgtggacggcaaagctaaaagagyacactgtaacacatgccnnncccacttgggcttcrggagtcacaggcacccacccctagatgctgccatggggccagagcccaaaagcactcaccccagctcctgcwcctgcccgtctgcatgctccccctcctgtaaggggtttgagcgtgtggcgaccnaacagrngagccacacccctgtcrcatgtcctgcragggggrtcagggaactctcccatttca

SEQ ID NO: 391 - DNA, 449 bp, Homo sapiens
  repeat_region (1)..(449): ltr2
taaggaaggagaccacctctcccattgtctcctgtttcatgagaaagcaaaaagttaaaaaaagaagcagaagtgagatcaatggccagatggtttagtgccaagaaccaggcctggtagttaaacatcaactcctgacctaaccgcttgtgctatccatagattccagatattgtatgaggaagacttgtgaaactttctgttctgttctgctagcccccatcactgatgcatgtagctctcagtcatgtagcccccacttgcacaatgtatcatgaccctttcacgtggacccctcagagttgtaagctcttaaaagggacaggaatctttactttggggagctcggatcttgagacgcgagtctaccaatgctcccagctgattaaagcctcttccttcatagaaccggtgtctaagaggttttgtctgtgactgttcctgctaca

SEQ ID NO: 392 - DNA, 512 bp, Homo sapiens
  repeat_region (1)..(512): ltr20
tggtawtgaaaggagttagccagcttgctttaggcagacagtaagggaaagggtccccagagaacctccgacccgccccacaagtgtttacaccagatgttttgtgcagataagggaacttgcacagggggcttgcctaracatkcccacagtgaaaaattttwttcyttaacacatgckcagtaagaaaaataaatcaatatggagtagctcagactragggccyacatgcgcactggaaggatggggtggagccaccaggaattcgcaccttatgcaaatrrggaaccagcctcatcagcttytstataraagcyctkgtattcaactgtgaagtggcaaccwgmaacctgctttcaggacccctctcttttgctgagagcttttctcttcctttcgcttaataaattctgctcyacctcacccttcaatgtgtctgcatgcctaattcttcctggtcatgagacaagaacctggatytagctgagctaaggagcaaaaaccctgcatca

SEQ ID NO: 393 - DNA, 569 bp, Homo sapiens
  repeat_region (1)..(569): ltr20b
tgagagaggagaaaggaagaaactggtcaggcaggcagttagggtgggtcctcggttgaattctttcaaacaaaagaacagcctgcaggcacagataagggaacttgcacaggggggcttgcctaagacatgcccacagccgcacagataagaaaggctacacaggagacttgcccagacatgcccgcaatggaaaattccgtcccctgacacatgtgcagtaaggggaacaaagcaatatggagtaactcaagctaagggcccgcatgcgcactaggaggatggggtggagctaccagaaattcgtgccttatgcaaatgagacacccagccctcatcggtttcttataaaagcctttgcattcaactgtaaaaatggcaaccctcttccgggccccctctccgcggcggagagctttcttctttcgcttattaaactttcgctccaacctcaccctttgtgtccatgctccttaattttcttggtcgtgagacaaagaactccgggtgatacctcacaaggagagactgagagactgctacattgtggtgcattggcgagactaaca

SEQ ID NO: 394 - DNA, 505 bp, Homo sapiens
  repeat_region (1)..(505): ltr21a
  misc_feature (257)..(257): n is a, c, g or t
tgttagggacaaactgcccccaagaaagcttcttggtgctgcccacccctccccgcaaacctctccgcgctgcccacccttcccccaagcctytttacatttctaagcccttatctaggcaccacggtgaagccagcctgatagaagacttyacytatcagrccttgctgcaataaagcaaaccccaattacaaaccatccggaccgcacagggggaggtcgtgggaarcataaacaaactttacctacaccctccngtaccgtaaacgtcacaaggtgatatgtggcaraattaaccagcaaacaaccccgggatgcrgccataccaaagractccctcaaactccctkccccaatrtaaacccctcattctgtaagcttggggctgcttyccttgactgtkawgggggcagccgrcaggttaataaargcttgcctgaacttggggctctctctctytggtcctttctctcggctraccttacattctcactctctaagttca

SEQ ID NO: 395 - DNA, 438 bp, Homo sapiens
  repeat_region (1)..(438): ltr21b
tgttagggtcrcccyraycagacyrytcccttcccctcccacaggmcttacaatayrgtccyttgyrctctccgcacagctaccccagggcaaaaracaaaycccccttcactgayccytccagtaactgtscrgacagttacaggatgcggtyaacatrtctgttcacctcgcataacaaagctggcaaaaaaacatctccaggatgcrgacaagwcacytgcacccyygactcactcagctccccsacccyracccagttctcctgcacccccaactcagctcccgcaccccgacctrgttctggccctataaaarcctgctatwgtctgtaagyrggkctgcctcctyyaactgtggtrgagcagccaagcagctcaataaagcttgcttgcctgactttgggtctcytcatcctttctctcggctgaccttaca

SEQ ID NO: 396 - DNA, 580 bp, Homo sapiens
  repeat_region (1)..(580): ltr22
  misc_feature (431)..(431): n is a, c, g or t
tgtdgggrttcastcaggvtggtggsagaaatattaaagggaaatattagggaaagttataggaaataghcacaaaccttcttggaaggcctgaragtttgcawaacttcrgtaatagathtggctgaaggcagccarttcccttaccttwragcattarakcatagggtaaatacwaaggaawatagaggcttccccagttaagtctgtttaycctacytccattaactagcttgttkastcakgtggtcctmttggggmaggtcgaccagggatattgccccstaatggtatttacttyagaccwgggtgcctragctttaatcattactwgggstactctcttaacmatgtyaattacccwcwagtgtgttgactcaaagcctttgtyawtwaatctatactraataaatgcctgsagtgcyagctgnttagggccagcwgcwgtkacaaacctyycttggwgtstgtaagcggcctggacactcagctggactggcaaagcagaatatctgtgtgtcagtgtacrttttattcatccgtcatttgggtcagggtctgcgggtgacagacccccaca

SEQ ID NO: 397 - DNA, 458 bp, Homo sapiens
  repeat_region (1)..(458): ltr22a
tgtgggagatcggtcagagtggtgggaaaaactatagggaaaggacgcaaaccttctgaaaggtcagaaggttctgcagagccccgggggagaatagctgaaggcagctgttctataaccctgaggcagagggcaaggagtaggtacaagggagtgtaggggaatttatcttaaacaggcttgtttacttatgttgaccaggaactgacctttgatcatccgcgcgcgtgacgttccctgaaaggggaacaataaatgttaattacccgcaggttgtgtttgctccaggttttcggcattgtgcctgcactgaataaaagcaagcagctccagcttctcggggctgctctctggccactagagccaggcagtcacctagctgctcttacgctgcatacctgtgtctgagtactcatttcatccatcggtcggccagggtctgcgggacagacccggca

SEQ ID NO: 398 - DNA, 492 bp, Homo sapiens
  repeat_regionq (1)..(492): ltr22b
  misc_feature (234)..(234): n is a, c, g or t
  misc_feature (306)..(306): n is a, c, g or t
tgtaggggttcagtcaggctggtgggaaaaatattagagatagttatagaaatagacacaaaccttcttggaaggccgggaagtttgcataacttcggtaatagatctggctgaaggcagcctaatccctttacctttagttaaataaattagagtagaaacaaaggaatgtagaggagtttatctagmtagcttgtttactcatgtggtcytaagactaacctttgatctacngcaggtgcttaattgctttctacttgggaagtccacaatgtcaattaccctctagtggtgttgactcaagcntttgtcaattaatctttactgaataaatgcgagtctcactggctggtcggcaactgtttacagcactctcctgggagtctgtaagcggcctggacmctcagctggactggcaaagcagaatatctgtgtgtcagtgtactttattcatccgtcactgggtcagggtctgtgggacagactcccaca

SEQ ID NO: 399 - DNA, 437 bp, Homo sapiens
  repeat_region (1)..(437): ltr23
tgagaaaagaaaaaatagctyagagcagtctgagctatgtgaggtatgcaaaatttatcaggcccagagagacatgagtatgggacttcagtcatgtccctactccccctcrccatgcccgggggcaattgtttgaaggcattttgttcctgactagctgcctcatccattatcttcatgttcctggaatttgtgatacaaagaacaatgtatagccaatcaatagcywatgttattttaatgtaaattyytggtaaacaacttaaggaactscctcttctttttttcctttaaaaaccacttgtaactgctgctaattggagtgtatattcagggcaacttgaatctatgctcccaggttgcagtcctcaagcttggcccaaataaactctctacttatattaattttgcctcagctttttccttttaggttgaca

SEQ ID NO: 400 - DNA, 490 bp, Homo sapiens
  repeat_region (1)..(490): ltr24
  misc_feature (131)..(131): n is a, c, g or t
tgtraaattaaataattcaaacttaaagctgttggaacttkaaattattctgagccttgagaggaatgtggctatgcggcctgagtcatgtagcatgcagctgcaacttctgcttytctgatttagattancttttttccttattcctgtactgtaaatrattaggaagaccaaatggcgccagagataagaccccctcagatcactaccccttctcacagaatgataaagyaatcttccttggaatgtagcaakctgtaaccaatcaaatcgctgtaacatatgcactggycttgtatggaaaatgttgtaatcctgctaaaatttctctgtctctgcctatataagtgaaaccttaacttctccactttggaacgctgaccccattcctttggagtctgtgtttcctgggtggccatcctcaagctttgcgctcgaataaactctatacttaatcatattttctgaatctcattatttaaggttgaca

SEQ ID NO: 401 - DNA, 576 bp, Homo sapiens
  repeat_region (1)..(476): ltr24b
  misc_feature (7)..(7): n is a, c, g or t
  misc_feature (179)..(179): n is a, c, g or t
  misc_feature (189)..(189): n is a, c, g or t
  misc_feature (487)..(487): n is a, c, g or t
  misc_feature (494)..(494): n is a, c, g or t
  misc_feature (500)..(500): n is a, c, g or t
tgtaaantaaaataaaatttcaggaccctctaaatttattatgccaagggggaagttaagccctggagactgagtcagtagcatgtttgcaattctgtttcttagattatagattaactctcttcctcattgttcttgttctgtaaatgactaggagagaccagagaccagacctcccnccagctyccnttccaatcactgatctttgttatagattaactgcctcctttattgtcctgtacctaactcagaccagatggtgcaaaagaccccatgactgttacatcttcagtgtggaatgttaaatatacctttcccgaaagaaaaagaccaccttaactaatcagattgttgtaactatgcattaagccttatatagaaagatgttgaaattctgttaagcttccctaaactttgtctatataaatgatcccaaacttctacacttcggaacactgacttccattctttggaatctgtgyttccngggtggnccatcntcaaactttgcacttgaataaactctctttaaactagattctgacccttttgattattttaggttgacagtgcyta

SEQ ID NO: 402 - DNA, 794 bp, Homo sapiens
  repeat_region (1)..(794): ltr25
  misc_feature (477)..(477): n is a, c, g or t
  misc_feature (786)..(786): n is a, c, g or t
tgagaggagttaactaacttgccttaggtagacagcaagggaagggtccctggagagcccctgacccacgggtcagtgcctcatccccacataacataaaaaagcagcctgggaaaaaaaatcaagctgcaggcaccaataagggaactagcacagggggttgtgcctggagacatgcccacggctgcacagataggagaacctccagcccattcagataaaaacttacacaaacctccggctcactcagataaagaaacaaggcctgacataraaatgcctttgtcctttgtataatcagcgggctcccaggaaaaagtttcttctccttttgtgggcatgaacacagtgggctctggtgggttccggtggacactttcctttcctttttttggactgtaagcctggcctctatgaatcatcacttcagctcctgattgrtcccgggccaaggtcctgggccaaactgagtagccnctgtgaatcatcacttcaactyctgattggtcccaggccaaggtcccgggccaagctgagtcacacgttctccaagacagcccacagactaaacacattccttccccttcccagtccataaaaaccccagaccccagcctcatagkggrcaacccattcgggtccccctctccgctgrcagagagctttcttctttcacttattaaactttcactccaacctcacctttgtgtccacgctccttaattttcttggaggtrrgacaaagaactctgggtaytatctcagacaatgagagactgctacatnttggtgca

SEQ ID NO: 403 - DNA, 603 bp, Homo sapiens
  repeat_region (1)..(603): ltr26
tgaaaccgtccctataaactttataaaattaatcagggaagaagrgagggggagaaatgaaaataaaccaagcttgcagcacattcagcattaatcatkaggtcagcttgctctctgacctgcttcctcatagttgtttggtgcctattgcctyagaatcacgtagaccctgttacaagattatagttccccttaactgctctatagataacaacttgaacattatgaaacgttaagttttccctttgagatattccttcgggtcctgcataccgatgaaactactgacaactgacgycagctggtctgaaggaccccacgaggagctgactcaccaaagaatgcagtttccacatcctgatgatttcatcccccttaccccgaccaatcaacaaccccaattttccagcccctcgccctccatgatccccttaaaaaccccagcccagaactcctcggggagatggatttgagggtctcctcccatctcctcgctcagtgccctgcgatcattaaactctttctctgctgcaaaccctgctgtctcagtgtaattggtctgttactgcgcagtgggcatatgaacctgttggtcctataaca

SEQ ID NO: 404 - DNA, 622 bp, Homo sapiens
  repeat_region (1)..(622): ltr263
tgaaaccatcctcacagggctaacaagaattacatgccgggttctgggcagaaatatagttataattaagcattaatcaggctgcactttggcccacttccttgtaactaaaagtcatgtagcactagatactgaccatttgcatccccattgttcctatagataggatttctgaccttagaatcataggtttttgtttaagaattgatttgcatccccattgttcctatagacaggatctctgaccttagaatcataaggcttttgtttaagaattgcttaagatgtttttcagatcctgaattccagcggaacagctgatgccaaccagtttgaagacccccacagaggaaccgaatcagcatgagaacgcagtttcttcatctccctgtcccatgacttcaccctgcactcttcgaccaatcaacgatccccacacctcggcccactccaaaccccttaaaatccctagccccaaactcctcggggaggcggatttgaggtttcctcctgtctcctcattcggctgccctacgattattaaactctttctctgctgcaaccctggtgtctcggtgtattgacttgccgcgcatcgggcaacaaacctattacggtcaca

SEQ ID NO: 405 - DNA, 636 bp, Homo sapiens
  repeat_region (1)..(636): ltr27
tgtgagagcagcaggaggcagccaatgcctaggtaggcaggggcaggtccctgtgaaacctcacctccaggccgaagacagcttaaatcctgaaagccaagctaccatttaaatccttggaccagactgagaacttgtcttcctgtttggtgtgctttcctctgattgatccctacccttcacctattttatgtatacctaccctttcctaattggttttctgtactgccaggcccacttctgcgtggtgtctttgctttaaccttttttgcatactcacaaaccaatcagcatgcactccccattctgagtccataaaaggccctggacccagccacatgggggactttcctgccttcaggtagggggaccacccctgtgtcccctctgtatttaaagctgtttcatcattcaataaaattcttctctgtcctcctcacacttcaatgttcagtgcatcctcattcttcttggatgtgggacaagaacttgggaatcagtgcacaagccagacttggcctgggaaggccaactgggcagggcacctcctgcggcagatagcatgccctgggcaaggcctctggcatcgccagccagaagtccctgactggcaaagggaccgagaaaaatcctgca

SEQ ID NO: 406 - DNA, 1020 bp, Homo sapiens
  repeat_region (1)..(1020): ltr28
  misc_feature (356)..(356): n is a, c, g or t
  misc_feature (379)..(379): n is a, c, g or t
tgatagcgacaggaggcagmcaaatgcctaggcagataggggcgggtccccggtgaaaccccaccttcaagccaaagacagtttaaagcctgaaagccaagctacaagtcccggataaatcctcagaccggaktgagaacttstcttcctgtttggcgcgctttcctctgattgatccccacccttcacctattttacatatacccaccctttcctaattggytttttacactgtcttgcccaccttcgaatgttgyctttkttttaaccttttttgcatactcacaaaccaatcagcacgcactmccccccatcctgtgcctataaaaaccccagactcagtcagtagaggagangacagcttgacttcatasttggnagaagrattgggagagagacaacctgacttcagggaagacgacctgcccttcccgtcccctctccagctcccctctccactgagagccgctttcatcactcaataaaattctccgccttcaccatccttcaattgtcagcgtracctcattcttcttggacgccggacaagagctcgggacccaccgagtgcgggtacccaaaaaggctgtcacactggccctttgccctcgctggcggagggcagccgccccacatgacagaagcagcggcggggctgagccagccchagagccaygggctggagtgaggcaaggggccgactgagctgttaacacgcatccgtctgcagacggcagaactaaaagagctawttagcayactgtaacaccccctctggggcttcggggtcgcgggcayccytacctgggtgctgccgcattcccctccaggtgacatgcctggtctggccgcaggccctgcacagagcttgctcctgtgccggtgcccgaagcagccggccagatcccgcactcgctcgctcgcgtgctccctcccgcaaggggytgagcgbggcgggctgagtagacggggcacccctgccatgagtccggtgaaggggycaagaaaaatcctgcatca

SEQ ID NO: 407 - DNA, 619 bp, Homo sapiens
  repeat_region (1)..(619): ltr29
  misc_feature (87)..(87): n is a, c, g or t
  misc_feature (89)..(89): n is a, c, g or t
  misc_feature (107)..(107): n is a, c, g or t
  misc_feature (199)..(199): n is a, c, g or t
tggggctcagaaaccgataccccaaaatatggcgttttgwacatgctgaactgaagaagcctcaaggtttctctgacctccccccanancccccactgtctctcccnaatataagttgaagttcccttatctgcctaaagtccagacccaccaaggagaacaattgttttttgttcccctccctgagtttatctcattngaatctattrcaggaaagaagaccaaagaatgtaaccacacctgaacagaccctttttcaagataatgacttttgtcacaaaycattgtctccaaggatcatttaaattccaaagagaactatttacaagttaatttctgttccyysatccaagatccawtcattctccctagtaatcatttattgcccctcaatagaattcctcttctcccccttcccataacctgttttaccaggatccaagcccccattctttctgtaacctcaagatggtatataagcttctgyacctcattgggaagttgggtcttcattctgaaggctcccatgtatacacgttaaataaatttgtatgccttttctcctaytaattaatctgccttttgtcagttgatttttcagcaaaccttcagagggcca

SEQ ID NO: 408 - DNA, 490 bp, Homo sapiens
  repeat_region (1)..(490): ltr2b
tgagggaagagagagaccctctcatattgttttatattgttttatactcagtacctgttttaagaaaaaaagaaaaaacaacaaggaagtaaaaccaaagacaggcagcccggcgccaggcccgaaaccaggcctgggcctgcctggcctaaacccagtagttaaaaatcaactcatgacttagaaaccgatgttattcatagattccagacattgtatagaagaacattgtgaaactccctgccctgttctgtttctctctgaccaccggtgcatgcagcccctgtcacgtaccccctgcttgctcaaatcaatcacgaccctttcatgtgaaatctttagtgttgtgagcccttaaaagggacagaaattgtgcactcggggagctcggattttaaggcagtagcttgccgatgctcccagctgaataaagcccttccttctacaactcggtgtctgagaggttttgtctgcggctcgtcctgctaca

SEQ ID NO: 409 - DNA, 429 bp, Homo sapiens
  repeat_region (1)..(429): ltr3
gttggaggccgaaagaatagggtcgtgaccaactcagtataccactggaggctatatgagcaaacagcaaactgttctcatgaatgcaggatgctggcaagctgacaactgcatctgccaccagaaggaatgctgagggcagtcataccccacgtgcagtgttccttgtggttatctataggaatatctggaggctgttgtataaagaaagcaattatgtgagcccgtgataaatcaagcagctgaccaaccattacctcttcctccctgttgattctacctaataaatacaaagggctgtagaagctcagggcccttgttccctagaagaaaggagccgcctgtctccttctttaaaacagatctttttgtctttgtcttcatttctgcatttgttctcttttgttcagtcccaaaccgacagccata

SEQ ID NO: 410 - DNA, 722 bp, Homo sapiens
  repeat_region (1)..(722): ltr30
tgagaggaggtkccagctgggcttcctgggtcgagtaggggctcagaaagctgtgaaactcactcatttcctgcatcaggacttacttcggtcctggatgaataatattgaagatatatgcttaaaatattcctaacaycaggatttgtgcatgtgttttcttccccaagaaagctataaacagcaaaaattttgctgtaagcttccctgtgtccttctctccctctctcccttccccctcccctaaaactaaagtaaaaggaatgttaaaagcccattattttctgtgaccagcagaccttatctatgctcccaattccaattccttgtaaacacactttgtaaartcctgtragatcctgtctcctttgccatgccgctgcaaggtyataaagtagataaaacytaagttrcaattccggttttcctcaagatctaagacatgtcmcaaaataatttactgyctttgtttcttgctctggtaacatcttcccgccgcacgtatttcccgccttaaagagtttaaaaggcgatcaaacaaatctaacactggctacccgctcgggaccccttccacgctgtggaagctttgtactgtcactctgctcaataaagcctacagctttttttctctcttggtccgatccgtgtctctcwctcgccgcgggcwgccgccacaccaaatctttggcgtggctaaggcaagaacctttggcgttaca

SEQ ID NO: 411 - DNA, 619 bp, Homo sapiens
  repeat_region (1)..(619): ltr31
  misc_feature (36)..(36): n is a, c, g or t
tgcttgcttttggtcacttgctttgtgttatcgttnttattkttttcctttttccatgaagctgaaggccgcagtagctgaaggccttgccgctgaatgctgaaacttaaccttcactggctactttatagataacattcataggtcaccacggtaacggttgcttacagttgtttttcarggaactkgggccagctcctgtccagttcaaaccggttgagaccackaacccttcaactgggcctgcgcaagtgcccaagaggtggccttttgacgtcggagggccaaaaactccaccctcagatcacgctaacgccaccattttctgtacatgtgtcctatgaartgccatgaagcccgactacgcttgcgcagaatgaacctrttacttcatttttccccactgccaatcacctttccccacaccttagaccaccccgcttctctaacccataaatatccctaagccttatcttcggggaggcggatttgagagctgttctcccgcctcctcgcttggcggccttgtgaataaatcttttctcttttgcaaaacccatcgtcacagtgattgrcttactgcgcgcgggcagaacggacctggacctggccagtaaca

SEQ ID NO: 412 - DNA, 471 bp, Homo sapiens
  repeat_region (1)..(471): ltr32
  misc_feature (5)..(5): n is a, c, g or t
tgtcnataaccaagtgtatggtagacgcacctgacagcaataacttaagcataccctgagaatgaccctgtatggcagatgcacctgaatgtgtgtttggagttctgagctaaggaatccgggagtggccaacccggagattcattccttatctatgaggaacatctgagcccccggcccgtcccgtggaacgcaggccatacaggggatcgaggccctttgttttgggttaaatgaaggttgccaggtggaggttgttagggggagggtgctaagtgaaaatgctatataaactgcatgctttttrcaagcggttgcggttctcctgtccagcccaccaccactggactgtcttccctgtatgtaagtccccaataaaccctatgtctcatttgctggctctgggtctcttcttcggcctcttgaacctggtgccatccctattggagtcaataggggtccggcacaaca

SEQ ID NO: 413 - DNA, 521 bp, Homo sapiens
  repeat_region (1)..(521): ltr33
tgtgctggatatcttctgtttgcccctccagatccactctccacccttctccaccctgctctgtgccccgggaggctgacctctatggactgcatcamcgggctcccttgccctctggcttctggttgggtttggccaatgggaggcactggcaggagattggagggtggaaggagagwgagatcggggtatttattccccyggctccctccctgctgggctgcggtttggcagtggctgcgttcctctaccgaaggccacagctcctgtcgggcagccctctccttgtagctacagctmcagctctctctgggttccggtaacmgctccctccccttgccccttcaggcctaggggtggtaacagctycccgctgttgctagccccggggtgcttcaccatcccttgttggtttcccttaaccctgcccacacctttgtaaatagtcccttcattaaactctcctcaattactccatttgagtgtgccatctgtttcctgccgggaccctgactgataca

SEQ ID NO: 414 - DNA, 523 bp, Homo sapiens
  repeat_region (1)..(523): ltr33a
  misc_feature (49)..(49): n is a, c, g or t
  misc_feature (113)..(113): n is a, c, g or t
  misc_feature (126)..(126): n is a, c, g or t
  misc_feature (128)..(128): n is a, c, g or t
  misc_feature (200)..(200): n is a, c, g or t
  misc_feature (261)..(261): n is a, c, g or t
  misc_feature (403)..(403): n is a, c, g or t
tgcctatttgctctcagatccatccctgcccttytcctgctctgctctntatcacaggaactgcatttcccaggctcctttgccacctggcttctaggtaggtttggccaatnggaggcactggcngnaggagattagagggcaggaggaagggagaagccagggtatttctccccctccctctctgccttgggcagtantctctctagcagcagttgcatgcatctcctctgtggttccagctcctaccagacagccccnccctctgtggttccagcttctaccaggtggccctggctcctgggctctggtaattccacctcctccctccctttgtccctccagccctaggggtggtagtagcttcttgctgttgctaatctctgggttgcctcaccattgnttccctgtttggcttctcagctctttcatcacctgtgtaaccaattccctgtattaaattccctctgtttgaaatacctagagtggtttctgttttcctgattggaccctgactgataca

SEQ ID NO: 415 - DNA, 699 bp, Homo sapiens
  repeat_region (1)..(699): ltr34
  misc_feature (33)..(35): n is a, c, g or t
  misc_feature (40)..(40): n is a, c, g or t
tgtaaagaaaaataaaaaatctcaggacccccnnncyccntaaactccttatgcccggaggccgagtcattgcaacaccctcttccaaatgaatagctgttactagcatcatgcatcagccagatccccaaggaaaggtaaaaggcctcaggcatctgcaaaagactgcccccacagatcattcataagtaaattctttgctggcctcccataaacaaggacatgccaattgtaactttaggtctgcaacctaagtctagctcctaaaactaaagtctgttcgattccacactgataatgtcaattacaagcttatcttcccaggtgcagaacaaagacaaggtgagatcagtcatttcctccacctacccagagacgtctgcataattgactcttcctttactccctttttctcttcaaacattcaccttatcttatgtaaaatatagatttactgggcactaactaaagtctcacaggaatgtaarccatttgccttaccgcctacctgcccctcttcctacatgccttcccycactttaaggaaatgtataaatactaaacctcctgaaaacctcttcagaaaaagcagccacagatgtgtctgtggctcgcgtttttcccggacatgccctaaagctggcttaataaacctcgattgattgagacwtwtgcctcagtcactcattttggttgtca

SEQ ID NO: 416 - DNA, 599 bp, Homo sapiens
  repeat_region (1)..(599): ltr34b
  misc_feature (366)..(366): n is a, c, g or t
  misc_feature (476)..(476): n is a, c, g or t
  misc_feature (486)..(486): n is a, c, g or t
tgtgggagaccagaatatgccaccccaaaatatgcctctttggcataaggaytgttgagctgaaggcaattaagaagaagcagatgcaggaaagctctctgccctccctctatttgcctaaaagcaggacatagatttacaaagacaaaaggtatcctgcccccaccccttctaccagggagaacaaaggttaaccactgaagacaactttagacccttattggcctggagatggtaccagaggaatctacattaacaagccttactaactagcctttatctgccagttatttgccttcccacaagttgctgcccctagagactcaaagtccttttcctttgtcttgtcacttctctaaaaatttnttttactgttctttgttgaagatgctatataagctggaattcaaagccacctctttgagaactactcattctctgggtgtctcccatgtatatatgaaatatacatgttnaaaaataaanttaataaacttctgtctgtttttctcttgttaatctgtcttttgttacaggggtctattccaactaagaacttatgagggttgaggagaaaaaattatttttcttcccctaca

SEQ ID NO: 417 - DNA, 616 bp, Homo sapiens
  repeat_region (1)..(616): ltr35
  misc_feature (102)..(102): n is a, c, g or t
  misc_feature (167)..(167): n is a, c, g or t
  misc_feature (169)..(170): n is a, c, g or t
  misc_feature (610)..(611): n is a, c, g or t
tgagacagagtagggatggggcttggyttcagctcacccccactrgagcattctttcatgcattcccactgatcacaaaacccacaccactacctcactganactatayccgctawymkksrkrywywrrwmatasmmakwmwatawwswtyytttkkksmyyycwnanntttaaccatgccttttacttaaagaattccaggaactggccttaggagatcyaaacatcgaaccaaggttgcagagtgtcccacctcgggaaggaatgctgaacaattgatttacagccttgttgccgctggccagaccaccaggtggcccattactcaagataaccatcgcaaccagataatgctgacctgcataccctaccytcacgtgctttgcccagcccagcctgcataccctacccctgatgtcaattcccgcgctttgcctaataaaaaaatccctaccggctcttttcggggaatcagctcarggaattctckctctctcttctgctgtctcccttgtgcycragcataagctccaatraagccttgtctgggaaaactgcttggycccgtgttaatttcyattacatggrgagcccaggaacctgtggtcnntaaca

SEQ ID NO: 418 - DNA, 1450 bp, Homo sapiens
  repeat_region (1)..(1450): charlie1a
  misc_feature (249)..(249): n is a, c, g or t
cagcggttctcaaagtgtggtccgcggacccctgagggtccccgagaccctttcagggggtccgcgaggtcaaaactattttcataataatactaagacgttatttgcctttttcactgtgttgacatttgcactgatggtgcaaaagcaatggtgggtaaaactgctggcgccttagcacggatcaaggcagtggcaccaaactgtactagtagtcattgtattcttcaccgccacgcgctcgcagtnaaaaaaatgccagtttcacttaagaatgtccttgatgaagcagtaaaaatkattaattttattaaatctcgacccttgagyacacgtctttttaatattctgtgtgacaaaatgggaagtacgcataaagcacttctgctgcataccgaagtacgatggytgtctcgaggaaaagcacttgtgcgattgtttgagttgcgagctgaactagctacttttttcatggaacaccatttttacttgaaagaacgactgacagacaaactrtggttattcagacttgggtatttggcagacattttctcaaaaatgaacgaagtgagcctgtcacttcaaggaaaacaactgacggtatttgttgccaatgataaaattcgagctttcaagcgaaaattagaattttggaaaacttgtatctgccaccgtgagcttgacagcttcccaatacttaaagacttttctgatgagatcggtggtgatattaacgaatgtgattttttgatattgtataatgaaatgtgtcaacatttggaagatctgcataactcagtgaaccartattttccaaatgaccaatgcatgatgttacaaaatcatgcatgggtaaaagatccattcaaagcgcaagatagaccaatggattttaatgtaacagagtacgaaaagttcattgatacggtttcagattccacaccgcaactaacctttaagaaactaccacttgttgagttttggtgtagtatcaaagaagaatatccacaattatctgaaaaggctattaaaatactcctctcttttccaactacatatctgtgtgaggccagattttcttcatatacttcaaccaaaacaacatatcgcaacagattgaatgcagaagcagatatgagaatccagctgtcttctattaagccagacattaaagagatttgcaaaaatgtaaaacaatgccactcttctcactaaatttttttgttttggaaaatacggttatttttcataaaaatgttatttatgttaacatgtaatgggtttattattttwaaatgaatwaataaatattttaaaaatttctcagttttaatttctaatacggtaaatatcaatagatataacccacataaacaaaagctctttggggtcctcaataatttttaagagtataaaggggtcctgagaccaaaaagtttgagaaccgctg

SEQ ID NO: 419 - DNA, 518 bp, Homo sapiens
  repeat_region (1)..(518): charlie1b
cagcggttctcaaagtgtggtccgcggacccctgagggtccccgagaccctttcagggggtccgcgaggtcaaaactattttcataataatactaagacgttatttgcctttttcactctcattctctcacgagtgtacagtggagttttccagaggctacatgacgtgtgatgtcgcaacagattgaatgcagaagcagatatgagaatccagctgtcttctattaagccagacattaaagagatttgcaaaaatgtaaaacaatgccactcttctcactaaatttttttgttttggaaaatatagttatttttcataaaaatgttatttatgttaacatgtaatgggtttattattttwaaatgaatwaataaatattttaaaaatttctcagttttaatttctaatacggtaaatatcgatagatataacccacataaacaaaagctctttggggtcctcaataatttttaagagtataaaggggtcctgagaccaaaaagtttgagaaccgctg

SEQ ID NO: 420 - DNA, 224 bp, Homo sapiens
  repeat_region (1)..(224): cheshire_a
caggggtcggcaaactatggcccatgggccaaatctggcccaccgcctgtttttgtaaataaagttttattggaacacagccacgcccattcgtttatatattgtctatggctgcttttgcgctacaacggcagagttgagtagttgcgacagagaccgtatggcccgcaaagcctaaaatatttactatctggccctttacagaaaaagtttgccgacccctg

SEQ ID NO: 421 - DNA, 338 bp, Homo sapiens
  repeat_region (1)..(338): cheshire_b
caggggtcggcaaactatggcccatgggccaaatctggcccaccgcctgtttttgtactgcccgtaaactaagaatggtttttacatttttaaatggttggaagaaaaatcaaaagaagartattttgtgacatgtgaaaattatatgaaattcaaatttcagtgtccataaataaagttttattggaacacagccacgcccattcgtttatatattgtctatggctgcttttgcgctacaacggcagagttgagtagttgcgacagagaccgtatggcccgcaaagcctaaaatatttactatctggccctttacagaaaaagtttgccgacccctg

SEQ ID NO: 422 - DNA, 6896 bp, Homo sapiens
  repat_region (1)..(6896): harlequin
tttcttggttccctgaccaggaagcgaggtgattaacggacggtcgaggcagccccttaggcggcttaggcctgccctgtggagcatccctgcrggggactccagccagcytgagtgacgcggatcctgagagcgctcccaggtaggcaattgccccggtggaacgcctcgccagagcagcgcgtggcaggcccccgtggaggatyaacrcagtggctgaacaccgggaaggaactggcacttggagtccrgacatctgaaacttggtaagactagtctttggaacttgccccactccatttgagtggaagcgtggcctgatcacccayggtgtgcctgtactggcactttggtttttgtttttgacttgacttggattgcttgatactttggttttggttttgacctggcttggatttctggatactctgattttggttttgattttggtttggtgtaaactgtaaaagtgtgtgtgtgccctttttacccgttctttgttttgtggtgtgcatgtggtgtgagcgtggtgttttgtctcgaagaagcatgggtcaggcacaaagtaagcccaccccactaggaactatgttgaaaaatttcaagaaaggatttaagggagactatggagttactatgacaccaggaaaacttagaactttgtgtgaratagactggccagcattagaggtgggttggccatcagaaggaagcctggacaggtcccttgtttcaaaggtatggcacaaggtaacctgtaagccagggcacccagaccagtttccgtacatagacacttggttacagctggttttagaccccccacccccacagtagttgagagaacagcagcataagcggctggcagaggcaaggaaagaccagcagagagavagagagaggaaagagacagagaggaaaagaggcaaagagagagaggaaaagacagagaggaagagacaragagacaaagagrgagtcaagaagagagaaagagggaggcagagagagaggaagagacagaggcaaaaggaaagtcagagagagacagaaagtcaaagagagaaagaaagagagaaatatacaagtagttaagaaaaaaaacagtgtaccctattcctttaaaagccaaggtaaatttaaaacctataattgataattaaaggtattctccgtaaccctgtaacactccaataccactttgttgtcagtgtaaacaagggcgtatcccraaagcactgaggccttcctatcaaaaatccttaacccagtaacccgcggatggcccaaatgcattcaatctgtagcggcaactgctttgctaacagaaaaaagtaaaaaaaataacttttagaggaaacctcattgtgagcacacctcaccagttcagaagtatcctaaagaaaagaaaaaagaaaaggatgatttaacattaaccactgaaaattctcttaacccagcagktttcctaacaggggatctaaatcttaattaccatacaaaggtccgaccagacctaggaggaactcccttcaggacaggabgatagatggttcctcccaggtaattaaagrrrgaaaaaaagccatctataccaattctaagttaatttggactaaacaaggtcttattaatagcaaaggataattgaaatcccaaacttacaaggttttcaacaaaagtaaagtttgctaaaagttaacagtgtaacatgtattatagtaacttctaatcttgtggccttagacagtctagtccacagacataaaggaagttcgctttggaaaagaatrgttatcatcttcgaaaaaaaaagagaggraagagggggcagaatttatgtaaaaagagtgttatatggtaaattcttgtcctgaaataaattaactggttgtttaaagaaagaaatgtttgtaataagtcagaaagttgagrcatgtcgaagaattgtctgcgaaagtcgtgaaagaaaaaaatgttataaaaaaagaatttatgcaaraaatgttgtataatttaaaagtaatwaggcctcctgaatgtaaaactattgaaaaaacagtttatgtgcaaggtgtataagaaaagtaaaatatacctttggtaaaaggattataaggaggcataagaatgtggatttttacctacattaaaaggttaaaaaaattattgttttgaaggtttaagcaagttttaaaatgttaattgtaaagaaaattctgtgtgtaaacatattagctaaagttaaagaggtatcatccagtttttctgtgaactggacattaaagtaaaaacgcaacgggtttttcttaaagcaccaacctgctctttaacaaaaattataaaaggttaaaaagagtctataaaaatcttaccttatggtcaaacattaaaaattgrataaatatgtctacaaagttttattaaaaytaagtttaacattaataacacactaatataaaggtaaaatttagcttatctggtataaaaatcatacaagaagcattgtyaaatataaaatggtgtttggctttctttggtctaaaaactaataaaaataggtgctaaaggaaatttctcagtaaaaaggcaccaaggactataaagtccactgctgatgttcccacatttaaaacaaaaggtcaatttcttaaaaattatatacttggtttatcttccactttcctttccctcaaaactaaaagtcttttagcacatgtaccacccctagaatttccagtaaaccagcaccagcctgaagatcacgttctcatcaaagggtggaaagaaggaaaacttgagccagcctaggaaggaccctaccttgtgctgctaaccaccgagactgctgttcgtacagcgaaaaaaggatggactcatcacacccgagtcaagaaagcgccaccccctccagagtcgtgggccatagtcccaggggaaaaccctaccaaactaaagctaagaaaaatttaactctttcatctattctattactctttcttctttcctcgctctattgctgaccatctagttattaacataaccaagtcaatttcgcctcaaactattgcatttaatgcttgccttgttataccctgtggggacttgccaagtcaaagacagctctctacttcagaaaagtacctctgtccctcctgactctcctcagactgggcattagtaaattaggaccatttaatccggggagatttcgataaagaccccagtgtcaaccaggagtcttgccccccaatgtagagcttttatgccatagttggtccaacgttctgtggaccactaaagagcaaggatggactgccccaaccggtttttgtaatttcctaaaatcatacattcattttactagaggatcatagaagttaaagacttaaaacaaactttggcaattaagacaggataccaagatgcaaatgcctggttggaatggatcaaatattccatccgcacgttaaacaaaagcaattgttatgcttgtgcacatggcaggccagaggcccagattgtcccctttccactaaggtggtcctccagtcgaccaggcgtgggctgcatggtagctcttttccaggattctacagcctggagtaataagtcatgccaagctctctctgctatatcccgaagtccagcaccctgtgggtcagcccccgagggccatccagcttccgtctcccaacactaagttcacttcgtgtctctcacgacagggaggaaacttagcattccttggagacctgaagggatgcagtgagcttaagaattttcaagagcttatcaatcagtcagcccttgttcatccccgagcggatgtgtggtggtattgtggtggacctttactgggcactctgccgaataactggagtggcacttgtactttagtccaattggctatccctttcaccctggcatttcatcaaccagagggaggaaaaataagacatcgtaaagcgagagaagccccttatrggtctttcaactctcacgtctatttagacgcaattggagtcccacgaggaataccagatcaatttaaagcttgaaatcaaatagctgcaggatttgagtcaatattttggtgggtgacagttaataaaaatgtagattagataaactacatctattacaaccaacagcaacgagcttttcatgagttaaaagaaaaactcatgtcggccccagccctggggctacctgacctgacaaaaccctttacacyctatgtgtcagaaagagaaaaaatggcagttggagttttaacccagactgtgrggccctggccaaggccagtggcctatctctcaaaacaactagacggggtttccaaaggctggcccccatgtctaagggccctggcagcaacggccctgttagcacaagaagcagataarctaactcttgggcaaaacctaaacataaaggccccccatgctgtggtgactttaatraataccaaaggacatcattggytaacaaatgctagattaaccaagtaccaaagcttgctctgtgaaaatccccgcataaccattgaagtttgcaacaccctaaaccccgccaccttgctcctggtatcagagagcccagttgaacataactgtgtagaggtgttggactcagtttattctagtaggcccaacctccgagaccatccttgaacatcagtagactgkgagctgtacgtggacgggagcagcttcgccaacccctgcaaagtgactctgaagaagacgacaagccctgctccagtcacacccggaagctgactggtccacgcacggccgaagcatgagaaaactcatcacgggactcattttccttaaaatttggacttgtacagtaaggacttcaactgaccttcctcagactgaggactgttcccagtgtatacatcaagtcactgaggtaggacaaaargttgctacagtcctattattttatggttattataagtgtactggaactctaaaaraaacttgtttgtataatgytattctatacaaggtatgtagcccaggaaatgaccaacctgatgtgtgttatgacccatctgagcctcccatgaycacagtttttaaaataagattaaggactgaggactgctgggggttcataaatgatacaagtaaagtgttagccaaaacagaagaaaaaggggtgcccaaacaagtcaccttaaaatttgatgcctgtgctgttattaatagtaatmagtataggaataggatgtggttctcttaattgraaaaaagaggctatacggcagaaaataagtacatctgtcatgaattaggactgtgtggaaataartgtaaatactggtcttgtgtcatttaggctacttagataaaaaatgaaaagaatcctgtccaccttcagaaaggraaaagtggcccttcctgtaccagtggwcagtgtaaccccttagaactagtaataaccaacccccttgatcctcactggaaaaaaggggaacgtgtaaccytaggaatcgatgggrctggactggatcctcgagtaaatatcwtagtttgaggagaagtttataaacgctctcctgagccagtatttcaaacyttctatgatgaactgaatgtgccagtaccagaaattccaggaaaaacaagaaatttgtttttgcaattagccgagcatgtagcccagtctctcaatgtcacttcatgttatgtatgtggaggaactgtaatrggagatcaatggccatgggaagcccgagaattagtacctacagacccagttcctgatgaattcccggctcaaaagaatcaccctgataatttctrggtcctaaaagcctcaatyattagacaataytgyatagcaagagwrggraaggahttcacycwtcctgtrggaagactyagttgccttgggcaaaaactgtataatagtaccacaaaaacagtcacctggtggagttcaaaccacacwraaaaaaatccatttagtaaattcccaaagttgcaaaccgtgtggacccacccagagtcccaccgggactggacagcccccactagattatactggatatgtgggcatagagcttatgccaaattacctgaccagtgggcaggtagttgtgttattggcactattaaaccatctttcttcctactgcccataaaaacaggcgaactcctgggcttccctgtctatgcttcccgcgaaaagagaagcatagctatagrwaattggaaagatgatraatggccccctgagaaaatcatacaataytatrggcctgctacttrggcacaagatggctcgtggggataycggacccccatttacatgctcaaccgaatcatacggttacaagctgtcttagaaataatcactaataaaaccagcaragccttgactattctggcccggcaagaaactcagatgagaaatgctatctatcaaaatagattggctctcgactacttgctagcagctgaaggaggggtctgtagaaaatttaaccttactaattgctgtctacacatagatgatcaagggcaagtagttgaagacatagttagaaatatgacaaaactggcacatgtgcccgtgcaagtgtggcatggatttgatcctggggccatgtttggaaaatggttcccagcgctaggaggatttaaaactcttataataggagttataatagtaatagaaacctgcttactgctcccttgtttgctacctgtacttcttcaaatgataaaaagcttcatcgctaccttagttcaccaaaatgcttcagcacaagtgtactatatgaatcactatcaatctgtcttrcaagaagacataggtagtaaraatgaaagtgagaactcccactaatgagtgagattctcaaagggggggaa

SEQ ID NO: 423 - DNA, 7418 bp, Homo sapiens
  repeat_region (1)..(7418): huers-p3b
  misc_feature (163)..(163): n is a, c, g or t
  misc_feature (219)..(219): n is a, c, g or t
  misc_feature (238)..(238): n is a, c, g or t
  misc_feature (241)..(241): n is a, c, g or t
  misc_feature (258)..(258): n is a, c, g or t
  misc_feature (300)..(300): n is a, c, g or t
  misc_feature (408)..(408): n is a, c, g or t
  misc_feature (851)..(851): n is a, c, g or t
  misc_feature (1175)..(1175): n is a, c, g or t
  misc_feature (1210)..(1210): n is a, c, g or t
  misc_feature (1306)..(1306): n is a, c, g or t
  misc_feature (1366)..(1367): n is a, c, g or t
  misc_feature (1387)..(1387): n is a, c, g or t
  misc_feature (1474)..(1474): n is a, c, g or t
  misc_feature (1510)..(1510): n is a, c, g or t
  misc_feature (1543)..(1543): n is a, c, g or t
  misc_feature (1694)..(1694): n is a, c, g or t
  misc_feature (1738)..(1738): n is a, c, g or t
  misc_feature (3383)..(3383): n is a, c, g or t
  misc_feature (4863)..(4863): n is a, c, g or t
  misc_feature (4880)..(4880): n is a, c, g or t
  misc_feature (5058)..(5059): n is a, c, g or t
  misc_feature (5076)..(5076): n is a, c, g or t
  misc_feature (5078)..(5078): n is a, c, g or t
  misc_feature (5089)..(5089): n is a, c, g or t
  misc_feature (5374)..(5374): n is a, c, g or t
ttttggkgcatgggcgggaaaacsaaggtacaacmttcattggagtggtgagtatggagtggacctcaaaatctgtcctttcatttcgaggctctcagcctccattttaaaactaaatcaaacgggcgtccttcagccttataaatatgattagcattggctnccgttctaaagactcggatgtcaggcttgctggggagaacatggagaatcccccantactcacgggttattgggnatnttggccatgtttgaacnagcttcgtttcatagagaacctagccatcatgtgaggctggnagaagtcctggggcaactgagaatttccggccggggcacaccctggcgtkattcaagggcctctggaccgacgcagcctccgacagccgggtgttagcaaaggatccncagctatcctgtcgccaaattttcctcctttctctatccatggtctcttacctctctctgtgtgttcaatgtgcaggaatctttacagttcagggaaaacagkcctgttwgamaagatcagtgaatcacggcagccagggatataactcaaagggaaggcatctttgtgattttctaggaacagaaccccccaacccttccacagtaagcgtttctcttggcccttggtctggagagcacatggcatttccatgtcactctctgcccttggtctggagagcacatggcagttccaggtctctctccccttggtctggagagtacatggcagttccaggtctctctctgcccttggtctggcgagcacgtggtatttctaagccacctagtaggaataaggatcctctccatgaggcacattgccggtcctctacggaacactncagcttccaattttccctttttgcgctcttttactgctacttctgtgaacgggaagactctgctttcaacaattaggagtaaaatgtcctccgaagccgaattttagtctcgatactgtcccatcagcaggaaaacggccattcggtccctacgttcttttaaggcacctattctgtctccaattaggatggtacttaattagtaaggggawttttaagtccggaagttaaccggaaccattcttctatgggtaaatgctttagcataggccataatagcaggatacagagttcaatctagcacgccccctcccttaaaggggncttgcccaattacatggtttttcttgaaatccgtnttttggaaggcacacaggccacacaagtctagaaggtcaaagggaaataaaaggcagaggactagactgcttggggamagcgtgactaaggaactnagttcctctggtgccacggcttggagggtcacacctgcagtcacgggtggcacatttaannaggtgccgggaatccggaancaacagagagaaaatagttggggggacgccccctactgttttcgtctccaccctggatcacataccgaaaggaaggagactaaaagnacgcttttattctcacttctctttctagatgggtancagatcgtcttcaacgtgcactcccctggagtntattttgaagcactgggactccttcgaccctgaaactttgaagaaaaagtggcttattttcttttgcacaagggcatggcctttttactagacctttgcaacattgcaaaatcaacccagctcttttagcaatcatatcaggcaggcccanggagaatgattccccaaaattagagaagcaactttcaggggaancatctgaggattcctcttatttggggccccttcaagttcccttctcattacaggaccttaggcaagtaaagggagacttaggccaattttctaacgaccctgataggtatacagaagctttccaaaatttaactcaggtatttgacctctcatggagggatgttatgctgctgctaagccaaaccctaactgcggctgaaaaacaggcagctctgcaggcagmagaaaattttggagatgagcaatatgtctcctatagtaggcmaaaagggaaaagagaaaatagggaaggcgaagaaataggggaaacamcattgccaataggaagggaggcaatacttcttgacaaccctaattggaactccagamttttctatggtgtttttccttctttcacggtttaaaatggcttctatcttcttttataatgttcttccaacctgggaaaagttaattttccaaaccttaaaatgcttggcttagagttgagctagggggaagggaacccagaagcctgacatgctggcaaaagggtaaacatttcttaccagtcgggcttttggcttctctctccctgtgcaaaccggtaaaagggataataaggatcattgtttatattctctgtaaakttttaattaatgaaaaaggatttgtgaggttggtcttaagctgtagmcaatctggtgtgctttgcgtgtctttctgtatggttctgtcaaaagaaagggtaccttaggttaggatgcaggcccaggaccccataagcctgctgttcaagccagcccaacaaaatggtcagtaacaaacttggctacaggcctccatcttgtttcatgtccttgggaacatgacctgtaaccacatggcaatactttgttttagtctccgccattttacaatggtggctgtcttcttgtgctaagtcagttcctgggtgagggccacaaaatcagataagccagtttgtcaatctgggtggtgccagctgatccatcaagggcagggtttacaaaatatcttaagcactgatcttgagagcagtttagggagggtcaaaatcttgtagcctccagctgtatgactcctgagccatggtttctaatcttgtggctagtttcttggtctggtccccaggcaagagggaagtatatcttgggaaggggctgttatcatctttgttttggactatagactgtaaaccaggcccctcccaaagttggttcagcctacacccagggatgggcaaggacagcttgggggctggaaacaaaatggagttgtttgggtsggatctctttcactgtctcagtcacagttttgcaatgacagtttcaaaagctgcctatcacccctttaaaaataccttgtacactcgtggttaagtcataacctaattaaggctcgttggtttcacctgtgaggttactttttgtaaagttcaaaagccgaaaatcttaactgcttggcatggctaaagtcgagtaacaagggatttaaaaggattttcttaaagagcgctcagcttaattaaaagtggatattcaagttataggtatatttaaaaggcctttatgtttttctcttcttgaatcttgcttttctggaaaagggsttttcttctcagtcgactgaattattttctccnttttttgtcttgccactcttaatgcatgcatgagaggccctaagataacttctggtagcatgggactccttgggaaaaacagaggaggcgccacagaccccgttttgggaaaaaacccctgttttcctcatgaaaccccaggaattaaaagcagatagttccctctcaaaatcaaaggctctgttctgttttgcattgtgttatctgacagttttgagttttgggggcatcagaattacttcacattatgagagagctttggtgtgtaataactaggtaggaaatacactktaagggatgsctaatagtagttataaatcagagaagcatgctcttggccacctgaaagatatggaaacatccccaccccccactgagagatgagactmccatgggggatgggctgattacaaaataagccaattggctttgggttgccttgcaatgaaatgcatggtagaagcactacactgtcttctcccatagtatctccctccttttggggatctaaaatctagtataaaaaggcacacttaattttgggatctgcctttgccttcagctgtgcttgcttattttgccctagaaatgcatgccttcctggcactgttcctccaagggctccaccctgaagcaagtaatccaattaagaaattggcaaatacaaaaatcgtacaagtgttgaatcttctgtttgtggtcgctataaatgtgttgtgtgtaatgtctataaaaagagctctaattgattggcttaaagaaaaataggcacttaagtcaaatattttttagttcatatgactttaatctttaagaaacaaaaatagtcttaagggttattggtaaaatgcaagtgtcatcaaaattcaaataggtggtctaaatcatacaacttagatactaggtttgctaaatgttccaaggttgtattactggttgctttacagataggtaaggccttggacacgtagagttagatactagaaagagtcaaaccttatctgtacttctatctgggtcctaggttccacacctggtaaataattacaatcacttactaaccaggtttttcaccaatgtaaaaattgctaagagttaacagcgcaacatgtatttgagatgactaaacagttttatctgcaaagtgtataaaaacagtaaagtatgtcttttagtaaaagattacaagaaagcatagaaatgtaaattttgcctagggataagggattatcttaaatttgatatgataaaggtaaaggtttaagtaagttgtggaagattgtaaaaattaatcttgcaaaaaatgtgtaaacattaactaaattcaaaatagtatatatggtcttttcacaaattgagcattgaaataaaagcacagcaaggakgtcttaagacactaatctgccctttagcaaaagggttataaaaggtttgtaaagatttcacctcatggtcaaattggttaagattagatggaatnatctataaggtttcatnaaaacgaactggggttaacattaataaactaatgcaagggaaaaatttggctttgaacaggattttcatgtaatagtaaaggctaatgaaaggtttttgccttttgagtcatcattttggcaaaataagtaatttatggcaatctggaattctattttgtaacatcaagtgttttaannctctaacacttaacagncnccccaaaatcnaacttcaagtttcaaaattgtctttcctgatgcctggctttctggatggttcagagggcccctgaaacattcagaaaagaggtaaacaggatcgtttgacatgtttagtcacatgagattgccaaaatgatgtccaatcttctttaagttatattttggtgaataatactaatatatgttccaaaattgtatgggatttctaaaattctaatgtctaagtatatgctatcaatcataattaagggtaaagttattgtaaaccacggagataactaaacttctttntcagtcatgtttttaactgtaactaccctggaaattttgtcattcgcagacaattgttgtcttgctttgttccttctcaaaagatggtttataatcaagctatattaaggactttaacaggtgttctcaaatgcaggtttttaatagctttgaagattgtaacattggaatagagaaagaacgtacaggactcatgaagaactgamatgttcacaaatatcaagcaaaacaagagttaactaagtggactgcactcagaaagttaaagcaacctttttgacttttgcttggaatattgctaatccttgttttgtttttcagagtcaaggaaacttattttgaactatttacggcctttaataattgagtaaggtatactcctgtgaacaaaatttggagcatgtttgtttttctctgcctggttcctctagaatktggaaactatctgtgagtactcttaacttatggcaatatagttgtttgcatcagtgcaatacgaatccatttttctttkkcaacaggacacaattggaaaaactggttattttaccaaggctttgactggaagggtgtgcttccctttaaggagtcaakcttgacatgcagagccaataaaagccccttggggagaactggcctcataccttgtctacacagtccccacacagggttcctgacctgtggtcagtaaagaatgtcactttctaacaggtccaggagctccaagtttatcttgggaccttaagaggagaggatcacccaactcacaggtatttgaggatacgaacccatggctgggctcggctttaaggggtcttatctgagattccttgtggaacagagttccatcaaagccaatccaaaaggcctatgtagaaataaccattcttgctgcactttatgcaaataatcaggccaagtataagactaaagtttattctacaaacaacacagtcctatcataatttgtttttaccaaaaatgagaactggagagaaaaattatgccccaaagcttatcatacatttgtcattaaatcctagtctcattaattgtttttaagctttttgcctacgttttagactaaccctgcttattcctgtgaatcamgtggtgatcttctgcagcttggaakaaaagaawagggatgggkaakgtaaaaatstgaatcaatatgctggttctgggcaattatcctgcaaattctgccaggtaatwaaagtgagtgagtagggtgcccatagcctggaggtttctttgtttgggaaaataaaacmagggaacttcatagacccccaaaggggaattctaatatcttggcaagtaaaattttaggtggaaattacctgccacaccacacttgtgggaactgctgtmctcaccccactatttkcaatagsgttacacacggtascaccttmwagctgaaatattggacagagagtttccattgccgtagtattctgcttaattattatccttatagcagggatagtagttactgacgaaaaggaagcatgaaagttttactatcaccgagtctgccaggactttttactgggtttagtgatgcasttttaaatgaaacatgctgcttctggattaamamctctastaaagtagaggaaaatctacgsgtacttagagatsaaatcaaaatcattgacaggctcagggaaaatgccggcttcagccccgggtggctacaatccctctttaatgaattccwgtcttctttatggaattggttaacccctttattaagcmctstcttgcttatmtgtcttgtattgatatttggaccctgtatactcaatactgtaactcaaattgtttcctctcgcctagaagcaatcaaactccaaatggtgctgcaaaccgaaccacacgccwttcttccaaggacccttagatcgacccaggaggagccctagctgctgttmcccacwcgatgscccctttcagcaggaagtagccagaaagagtcatcgcccaawccccccaacagcagttagkgtkgmmwctccasagsggggagtgwtgc

SEQ ID NO: 424 - DNA, 7417 bp, Homo sapiens
  repeat_region (1)..(7417): hervk14ci
tctggcacccaacgtggggctccccataatctctacaaataatccagtgaagaaacgccagagcgtggaaagtggaggacgactgacaaaggttgcccgagtacgttttcacttcaggctctacgggtaagtagggtgctcggagaattccagggtaacctcgggaaaatacgggtcaggctgaaagtaaatttgcaaattacttaagcctggtgcggcagttattgtgccacagcggggcaattgtgagtacccaaaatctcacatctttgttccatctcatagaaaagtattctcctttgttcccgggatatggaaccatgaatgtaaaagattgggacaaggtcggatcagacttacaaggagcacaacaagagggttacgatatttccttctccgcttggtctgtgtggtcagcaatcaaaacagcactggagcctttctacactgaggaggatgaggagtttcaggatgacatacaaaagtttaataatcaggagtctgatgatcagcaaagtgaaccatcacagtctagtttaaaaaagggggagaaacaggaagctacatgggctaacctccaaaaacttatgaaagaaacagttccacctactgaagaaacagtgccacctactgcgcctttaggggaaggtccggaacggccacccctgcctcagccttatgaatttttgtaacgagagcctgagacgcagcttgccactcccattgttgcacgccccaccattaactatggcaaagggaagcttcagtcttgcccaacagccaattacagtgagggaatgatccaggttggtccacctgttaattatggtagaggaatgctgtgaaccggcccaaatacatattatggcgcagggataatccaggcatccatttgccaggcatgagaaatgggggatttggatgcttggcagtttctggtaattatttcgccagctgaggagcctggagaacatgctcaagcgtgctgggagccatttccttttaaaatattaaaagacttaaagcaagcagttggacaatatgggccaaattctccttatgttcattccttgttacaatctgtggcgtataaccagcatttaatacctatggattgggagacattagcctgatccaccctgccccctctcaatttctccaatttaaaacctggtggatggatgaagcaataaatcaggcatgcagaaatgctcaagcccaaactttcattaatatcacatctgatcaattgcttggaagtggacaggcatggggtactctaaatcaacagatggtaatgggtgatgaggctgttgatcagctcagaactatatgcctaagagcctgggaaaaaattcactaccctggtactacttatccttcttttaactcagtttgacagggtcgaagggagccttatccagattttatcgttcgtttgcaagatgcggctcaaaaggctatttcggattttcatgccaggaaagtgatcgtccagctacttgcttatgaaaatgctaatacagaatgtcaggcagcaattagacctattaaaggaaaggcagatctaaatgaggaaaaaactttaagagtatacattaaagcctgtgatggcattggcaggcacttatataaggccagcctccttgctcaaggaatggctggactaagggtaacaaaaaacatatgagtgtgccctggatcttgctataattgtggacagataggacatacaaaaagagagtgtacaaagagccaaaaaaggcaaaactcaggaggaaaaagcagggaaccaagtacctttcctagaagtaaaaaaggaaaagactgtgctaatcaatgtcattcaaagtttgatgacagcagacagacagaacttgccaggaaacggacagaagggccagccctgggccccgattcaaaatggggcattcccaattcaggatgggatgtccccaactccaaacggagtgtcctcagcccagtctatccctgtacgaatgtacaggaattgtccccctccacagctaaaagcgggccagtagatttatgctgtaccgaagccgtatccctccttcctggggagcctcctaggaaggtctcagtggaagtttatggcccattgcgaaatggcacggtgggacttatactgggaaggtccagcttaaacttaaaaggaattcaagtacatactggagtagtggactctgattgccagggagaaattcaaattgttatctcctccactgttccctggagtgctaatcaaggtgacagaatagctcaaatgttgcttttaccatatgttaagttaggagaaagctcagaaaaaagaacaggaggatttggaacacaaattcagcaggcaatgctacctattgggtacatcaagtctctgacaatagacctatttgtatggttactattcaaggaaaacaatttgagggtctggtggacacagaagcagacgtgtcgatcatagctctttatcaatggccaaaaaactggcccaaacaaaaggccccagtaggtcttgttggggtcagaattgcttcagaagttttccaaagtacttttatcttaccatgtcttggtccagaagaacaggaaggcacactacaacctctaattatgcccattcttgataacttatgggggagagatctgcttcagcaatggggcacagaaatttcaatcccttctccccagtttggtcaagctagtcaaaaaataatgtcaaacatgggctatgttcccagaaaaggcctaggaagacagggggctggcattattgaacccatacaagttactgtaaaaaatgactgaaaaggattaggttaccatttttagggctggtcactgttgagtctccaagttctattcccttaaaatggaagacccaaaatcctgtttgggttgagcaggggccactttctcaggaaaaattgggggccttacaggaattagtcaaagagcaattaaacaaaggaaacattgagcccacatttcctccatggaattcgctcgtgtttgtaataaagaaaaaatccggcagatggcgcatgctaaccgacttacgagcggtcaatgcagtcatccagccgatgggggccctgcagccagggcttccatcccccaccatgattcctagagactggccattaataattatagatttgaaggattgcttttttaatattcctctagcagagtccgattttgagaaatttgcttttactattcctgctatgaacaacaaggaaccagcagccagatatcattggaaagtcttgccgcagggtatgttgaatagtcctactgtttgtcaaacttttgtggggaaggctattcaacctgtgagagatcagtttccagattcgtatatcattcattatatggatgacatattgtgtgcggccgaaaatcgagaccaacttattcagtgttactcatatttacaggaggtggtagccaatgctggattgctcatagcaccagataaaattcaaaccgccactcctttccaatatttggaaatgcaggttcaggaaagggcaattaaaccacaaaaggttcaaattcgaaaagactctctgaaaactaaatgattttcaaaaattattaggggatatcagttgaatttgacctactttgggaatccctaccatgttatgtctaatctgttctctattttaagaggagaccctgctctcaatagtaaatgataactgactcctgaggctgacaaagaattacaaataattgaagaaaaaatacaacaggcccaggttaatagaatagagtcaagtttaccattacagttcattgtgttccctactctccattctcctacaggggttatagctcagagtgaggacttagttgaatggtcttttctgcctcacaatactgttagaacactcacagtatacttggatcagatggcaatcttgattgagcaagcttgccttagagttgttaaactttgtggctcagatccagataagattataattccaatgaataaaatcagatttggcaagcctttgttaattcggtcaattggcaaataaatttagctggcttcattggagttcttgacaatcattatccaaaaaacaaaatttttcagtttttaaagctaacatgggtccttccaaaaattacccgtagtgctccattggaaggagcagtgactgtgtttacagatggctctagtaatggaaaagcagcttacgtacgacctaaaaacacaattattcaaactgactttcaatcggcacagaaggctgaattacaggcagttataggtgtgttcgaaaactttaagcaaactgtaaatattgtctttgattcagcttatgttgttcaagccactcaacacatagaaactgcactcattaaatatctggtggatgaacaactctatcagctgttttcttctttacaaaaggcagtgcatgatcaccgttttcctttctatattacacacatttgagcacacactaatcttcctgggccccttgtaagggctaatgatcaagctgatttattaatttccactgtgcttactaatgtccaagattttcactccctaacacgttaatgcagcaggacttaaacaaaaataacaaattacttggagacaggcaaagggcattgtgcaacattgccctcagtgccaggtagtacaactgccacgtgaaaggactggtgttaacccacagggattaacccccaatatgttgttgcaaaaggacctaacccatgtacctttgttcgggaaactttcatacgtccatgttactatagataccttttctcattttgtatgggcaacttgccaaacaggcgaggcggctgctcatattaagacattacttccctgtttcgctgccatgggcatcccacaaaagattaaaacaaacaatggcccaggctactgtagtaaatctttacaggcgttcctttaacagtggaacatcgagcacagtactggaataccctataattctcaaggtcaagccactgttgaacaggctaatcgaaccttaaaatctcaattacaaaaacaaaagacagagggggaaaccagagaatacgctactccttatatgcagctacaattggctcttatcacttcacattttctgaatttgtctagagatcacgttacaatggcagcagagcagcatttgacaaggcaaaaaataaatgcttatgaaggaaaacatgtgtggtggaaggacatcagaaccaaaacctgggaaaagggcaaaatcattacatggggtcgaggrttttcttgtatctcaccaggagagaatcagcttcctgtctgggtgcccacaagacatcttaagctgtgccatgagccagaatccaaggaagaggaaaagacctcggaacgtccctgcgcccccagttcgtcagacggctcagatgaacatctctgttgagcagatggaaaccagtaaaactcgccaagcaactccaccgacctgggggcagatgaagagactagctcacattgcagaagagaacctgaggtctcagaacaagctgctgaccaccagtaatctaatggtagctatgatggcggtaatctccttggcggtgagtctccccgtagctgaggcagatcaaaattacacttattgggcctacattccattcccaccactgattaggtctgttacatggttagaccccctggtggaggtttatgttaatgatagtatctggatgcctggaccaacagataaccgaggtcctactcatccagaggaggaaggaatgttaatgaatgtttccattggttatcgctttccttccatctgcctggggccagcagcaggatgtttaaattatgataaacaaatttggatggcttgtgtccctgcaaataatggatcaaaagcccctattcatgcaatcagtggaagaacatttcaatctttggacactattaaataccttgagcacggctatgttatgacacatcgccagattaataaatataaacctaataagaagccctgccctaggaaggccactaaatggtctggaaagctagaggtgctaacctgggaagattgtattgcaaacagcactgctgtactgcaaagtaattcctatggaatcgtcattgattgggcccctatgggacgctttgcagtaaattgtactggacagtgcgaagatggtagagagactccttttgcaaacgactacccagataatgcaccaaaattatatagaaaaattaaaacaaattaccctattaagtgggaggaaaacggtatggctctttcaagcccaaaaatgattgatccaattataagtccagaacatctagaattgtggaaattaatgatggctcaaaccccaattcggatttggaaaggagaatataaaacaaagacccttagtaaaaaacttcgatttgtcgtagccatgacctctaatcagacgttcccattgcagagttttgttaaacctcctcttatgttggcagtgggaaaaattaatatcctacctgactctcaaaccatatcatgcctcaactgtcatctttttacctgcgttaattctacctttaataaagataacagcattttaccggttagggcccaagtgggagtttgaatacctgtatccctcaatagaccttgggaggcctctccctccatacatattatcacggaagtactaaaaggaatacttaatagatcacagagattcatatttactttaatagctgtgatcatgggccttatagctgtcacagctactgctgctgctgctggtgttgctttgcactcttctattcaaactgcgggctttgtggatagttggcagaaaaattcttctaagctttggaattcccaaagccaaatagatcaaaaattggcaaatcaaattaatgatctctgtcaaacagtaatttggatgggagattggattatgaacttggagcatagaattcaaatgcaatgtgattggaatacttccgatttttgtattactcatagctcctataatgccattgaacaccagtgagagacgattagacgtcacctacaaggaaaaaaagataatttaacattagatattgctaaactgaaaaaacaagtttttgaggcatctcaggctcatctcaccctattgcctggagctgatattcttgctggagcctctgatggcctttctaataccaatcctttaaagtggattgaaaccataggtggatcaacaattgcaaattttattttggtttgtgtctgtttatgttgcttgtttttagtctacagatgcagatggtgccttgggagagaaaccagacaccatgaatgagccataatagcaatggcagttattaataaaaaaaaatcaatagaggcaaaaaaggggaaca

SEQ ID NO: 425 - DNA, 3285 bp, Homo sapiens
  repeat_region (1)..(3285): l1me_orf2
  misc_feature (10)..(10): n is a, c, g or t
  misc_feature (15)..(15): n is a, c, g or t
  misc_feature (354)..(354): n is a, c, g or t
  misc_feature (739)..(739): n is a, c, g or t
  misc_feature (1171)..(1171): n is a, c, g or t
  misc_feature (1639)..(1639): n is a, c, g or t
  misc_feature (1757)..(1757): n is a, c, g or t
  misc_feature (1876)..(1876): n is a, c, g or t
  misc_feature (1887)..(1887): n is a, c, g or t
  misc_feature (1962)..(1962): n is a, c, g or t
  misc_feature (2110)..(2110): n is a, c, g or t
  misc_feature (2174)..(2174): n is a, c, g or t
  misc_feature (2177)..(2177): n is a, c, g or t
  misc_feature (2238)..(2238): n is a, c, g or t
  misc_feature (2902)..(2902): n is a, c, g or t
atggcagacntaaancctaacatatcaatrmttacattaaatgtaaatggattaaacactccaatcaaaagatacagattgtcagagtggataaaaaaacaacacccaacaatatacwgcctatmagagacacaccttaaatataaagacacasataggttgaaartaaaagaatggaaaaagatataccatgcaaatwgtaaccaagagaaagccggagtggctatattaatatcagacaaagtagactttaaaccaagaaatattactagagataaagagggacatttcataatgataaaagggtcaatctatcagaaagacataacaatcctaaatatatatgcacccaanatcagagcaccaaaatacataaagcaaatactaatagaactgaaaagagaaatagacaaatccacaataatagttggagacttcaataccccactgtcagtaattgatagatcaactagacagaaaatcaataaggatatagaagacttgaacaacactatcaaccaactggacctaattgacatattatagaacactccacccaacaacagcagaatacacattcttytcaagtgcacatggaacattcaccaagatagaccatatgctrggccataaaacaagtctcaataaatttaaaaaaattgaaatyatacaaagtatgttctctgaccacaatggaataaaawtagaaatcaataacaaaaagatactctggaaaatncacaaatacttggaaattaaacaacatacttctaaataactcatgggtcaaagaagaaatcaaaagagaaattaaaaaatattttgaaataaatgaaaatgaaaayacaacatatcaaaaatttatgggatgcagctaaagcagtgcttagagggaaatttatagcattaaatgcctatattaaaaaagaagaaagatctcaaatcaataacctaagtttccaccttaagaaactagaaaaagaagagcaaattaaacccaaagtaagcagaagaaaggaaataataaagattagagcagaaataaatgaaatagaaaacagaaaaacaatagaaaaaatcaataaaaccaaaagttggttctttgaaaagataaaattgacaaacctttagctagactaaaaaaaagagagaagacacaaattactaatanatcagaaatgaaagaggagayattactacagatyctacagaaataaaaaggataataagagaatactatgaacaactttatgccaataaatttgataacctagatgaaatggacaaattccttgaaacacacaaactaccaaaactgactcaagaagaaatagaaaatctgaatagacctataactattaaagaaattgaatcagtaattaaaaaccttccaacaaagaaaagtccaggaccagatggcttcactggtgaattctaccaaacatttaaagaattaataccaatcctactcaaactcttccaaaaaatagaagaggagggaatacttcctaactcattctatgaggccagcattaccctgataccaaaaccagacaaagacattacaagaaaagaaaactacagaccaatatccctgatgaacatagatgcaaaaatcctcaacaaaatactagcaaancaaatccaacagcacatgaaaaggattatacaccatgaccaagtgggatttatcccagggatgcaaggctggtttaacatayaaaaatcaaycaatgtgatwcactacatyaacagrntaaaggagaaaaatcatatgatcatctcaatagatgcagaaaaagcatttgacaaaattcaacatccattcatgataaaaactctcaataaactaggaatagaaaggaacttcctcaanataataaaggnmatatatgacaaacctacagctaacatcatacttaatggtgaaaaactgaaagcwtttcccctaagatcaggaanaagacaaggatgtctactctcaccatttctattcaacattgtactggaagtcctagccagtgcaataaggcaagagaaagaaataaaaggcatacagattggaaaggaagaagtaaaactgtctttattkgcagatgacatgattttntatatagaaaatyctaaagaatccacaaaaaaacwactagaactaataaataaatttagcaagntcncaggatacaaggtcaatatacaaaaatcaattgtatttctatatactagcaacgaacaatntgaaaatgaaattaagaaaacaatwccatttacaatagcatcaaaaaaataaaatacttaggaataaatttaacaaaatayatrcaagacttgtacgctgaaaactacaaaacattgatgaaagaaattwaagaagacctaaataaatggagagatataccatgttcatggattggaagactcaatattgttaagatgkcaatactccccaaattgatctatagattcaatacaatcccaatcaaaatcccaatggttttttttgtagaaattgacaarctgattctaaaatttatatggaaatgcaaaggatccagaatagccaaaacaattttgagaaagaagaacaaagttggaggactcacattacctgatttcaaaacttactayaaagctacagtaatcaagacagtgtggtattggtataaggatagacatatagatcaatggaacagaatagagaacccagaaatagacccacacatatatggtcaaytaatttttgacaaaggtgccaaggcaattcaatggggaaagaatagtcttttcaacaaatggtgctggaacaactggatatccatatgcaaaaaaatgaasttmgacccctacctcacaccatatacaaaaattaactcaaaatggatyatagacctaaatgtaaaanctaaaactataaaactyttagaagaaaacataggagaaaatcttcgtgaccttgggytaggcaawgatttcttagatatgacacmaaaagcacaagcaacaaaaggaaaaattgataaattggacttcatcaaaattaaaaacttctgctcttcaaaagacacyatcaagaaaatgaaaagacaagccacagactgggagaaaatatttgcaaawcatatatctgacaaaggacttgtatccagaatatataaagaactcttacaactcaataataaaaagacaaataacccaattaaaaaatgggcaaaggayttgaacagacatttcwccagagaagatatacaaatggccaataagcacatgaaaagatgctcaacatca

SEQ ID NO: 426 - DNA, 1708 bp, Homo sapiens
  repeat_region (1)..(1708): ricksha_0
gggtttggatcataatcccaaaagacacaatcccaaacgccataatcccgaatgttgaaatcccgaaagatcaaaatccctaaagtctaaaatccctaaagtctaaaatcccaaaaattcacacaggatggttgcatcatgttaggcagaactgttattttcttattgtctttatgcagaaaaaatggattttaattgaatccccaaaccataatgacagatttggaattaggtgcgatcaaggcttctaaaagtgaatttcaaggtgttaccaataaagtttgtttttttccattcagcccaatgcatttggtggaaaattcagatgagtggattggccatgcgatacggcaacgacgaaaacttcagtttaaaaatgcgtcatttgcctgcattggcattccttccagctgatgacattccgggagcttttaatgaattaaagccgcatttgcctgaagaagtcagcgaagttactgactggttcgaaaataattatgtgcacggtaggataagaagacacttacacaacggtgttgccgttcgattaccagtattgtttctaccaaatttgtggtctgtatatgagtgcatgcagaatggatttctatatacccaaaacaacatagaagcatggcacagaagatgggaaaatttaatagggaatgctcatgtcggtgtatatcgaatcagaagattcaaaaagagcagcgccacgtagaaaatgaatgtgaacatattctccgaggagagccatgtcctaaaagaaaaaaaaaagcagctattcatcgcgatgcaagacttcaaaatatagttaatgatcgtgaaagtcggccagctcttatggactatctccgtgcaattgcccataatctatccctgtaatatactttttcatatgtcgaattttctttttagttttttttcactattttaaattgtcagcattattttttacaattcgctatgctatgtatttcatcttcgcatcatttccaatactggaggtataaattgtgtaaagacttttagagagttctaattcgttttatgcattttttgcaaatttgactccacgaaagtgcattatcacaacgttgactttgtgtgtaagcattgtgcgtgtacgtaaaaacgttgaaacttcctcaataaatgaagagatgtcctttttgtacatctgcatttgtgaaagataaaatttctcgagatctcggctctttgggcgactgcatatgcagtggtgacccatcgcggtttttgatcgatctcgtcaaaagacttaggttgttcgtcacggtatttcagatgaccgcagttataaagctgggtgcacacaattaccaaccatagtgatatgcgtttatacatttccctttttgacctatttctttatgaatacggttcgtctgctcataactgttatacccgtgcgactgtcattagtatacctgagtgtttatgcttgcaaaaatatgtatgttattattgcctattttattgtgtaaagtggcctatgaagtgttctgtcatgtttttatatgtttctcaaataaatccccttttaaaaatgtaaataaatatcttttaaaaaatttttaaattattttttccagaattatatttttgggattttgatctttcgggatttcaacattcgggattatggcgttcgggattgtgtctttcgggattatgatcggctccc

SEQ ID NO: 427 - DNA, 351 bp, Homo sapiens
  repeat_region (1)..(351): tigger5_a
cagatgctcctcgacttacgatggggttacatcccgataaacccatcgtaagttgaaaatattgtaagtcgaaaatgcatttaatacacctaacctaccgaacatcatagcttagcctagcctaccttaaacatgctcagaacacttacattagcctacagttgggcaaaatcatctaacacaaagcctattttataataaagtgttgaatatctcatgtaatttaytgaatactgtactgaaagtraraaacagtatggttgtatgggtacttgaagtacggtttctactgaatgtgtatcgctttcgcaccatcgtaaagttgaaaaatcgtaagttggggaccatctg

SEQ ID NO: 428 - DNA, 446 bp, Homo sapiens
  repeat_region (1)..(446): tigger5_b
cagatgctcctcgacttacgatggggttacatcccgataaacccatcgtaagttgaaaatattgtaagtcgaaaatgcatttaatacacctaacctaccgaacatcatagcttagcctagcctaccttaaacatgctcagaacacttacattagcctacagttgggcaaaatcatctaacacaaagcctattttataataaagtgttgaatatctcatgtaatttactgaayayartacactgtagartayyggttgtttaccctcgtgatcgcgcggctgactgggarctgcggytcactgycgctgcccagcatcgcgacagagtattgtaccgcatatcgcyagcctgggaaaagatcagaaattcgaagtacggtttctactgaatgcgtatcgctttcgcaccatcgtaaagttgaaaaatcgtaagttgggaaccatctg

SEQ ID NO: 429 - DNA, 30 bp, Homo sapiens
  misc_feature (1)..(30): oligonucleotide HIRA genomic sequence (positions 853946-853975)
cctacccttttcccgccccatttccaaccc

SEQ ID NO: 430 - DNA, 32 bp, Homo sapiens
  misc_feature (1)..(32): oligonucleotide HIRA genomic sequence (positions 859116-859085)
tgttcccctcaccttcctaactcagtgccctc

SEQ ID NO: 431 - DNA, 33 bp, Homo sapiens
  misc_feature (1)..(33): oligonucleotide for HIRA genomic sequence (postions 819901-819933 )
ccgtcttttgtcttcacaaccaagcccagagcc

SEQ ID NO: 432 - DNA, 34 bp, Homo sapiens
  misc_feature (1)..(34): oligonucleotide for HIRA genomic sequence (positions 823592-82355 9)
cactgcctgctcccccaaattgcaaaatgttgtc

SEQ ID NO: 433 - DNA, 30 bp, Homo sapiens
gtacttggctgatggtggcacaggctaggg

SEQ ID NO: 434 - DNA, 32 bp, Homo sapiens
  misc_feature (1)..(32): oligonucleotide for HIRA genomic sequence (positions 846946-84691 5)
actggatgtggcacctgactttcaaggctgac

SEQ ID NO: 435 - DNA, 32 bp, Homo sapiens
  misc_feature (1)..(32): oligonucleotide for HIRA genomic sequence (positions 875226-87525 7)
tggctttgacatctgaggcagagaaaccacgc

SEQ ID NO: 436 - DNA, 33 bp, Homo sapiens
  misc_feature (1)..(33): oligonucleotide for HIRA genomic sequence (positions 878074-87804 2)
gccgagcaatacatcaactcatgaccacgggag

SEQ ID NO: 437 - DNA, 35 bp, Homo sapiens
  misc_feature (1)..(35): oligonucleotide from PAC clone containing Necdin gene (positions 72122-72156)
ctcctcaagtgtcttcccagctacctcccagtttc

SEQ ID NO: 438 - DNA, 30 bp, Homo sapiens
  misc_feature (1)..(30): oligonucleotide from PAC clone containing Necdin gene (positions 75666-75637)
cagagccagcccccaccttaagtatggcac

SEQ ID NO: 439 - DNA, 35 bp, Homo sapiens
  misc_feature (1)..(35): oligonucleotide from PAC clone containing Necdin gene (Positions 94501-94535)
accctctgattcaggaaaggggtgcatacatggtc

SEQ ID NO: 440 - DNA, 35 bp, Homo sapiens
  misc_feature (1)..(35): oligonucleotide from PAC clone containing Necdin gene (positions 98601-98667)
ctttcacaccgtcacccagtcacatacaccaacac

SEQ ID NO: 441 - DNA, 32 bp, Homo sapiens
  misc_feature (1)..(32): oligonucleotide from PAC clone containing Necdin gene (Positions 76608-76639)
gcctggaaatcaatgcagccaactctgtcttc

SEQ ID NO: 442 - DNA, 31 bp, Homo sapiens
  misc_feature (1)..(31): oligonucleotide from PAC clone containing Necdin gene (positions 78898-78867)
ggcatgatactcagtgaaagacgccagtctc

SEQ ID NO: 443 - DNA, 30 bp, Homo sapiens
  misc_feature (1)..(30): oligonucleotide primer for CDC2L1 gene coordinates 13960-13931
cccccacccacatctccttgcagaagatcc

SEQ ID NO: 444 - DNA, 30 bp, Homo sapiens
  misc_feature (1)..(30): oligonucleotide primer sequence for CDC2L1 gene (positions 9137-9 167)
cctcggtttaccacctgccttggctccttg

SEQ ID NO: 445 - DNA, 30 bp, Homo sapiens
  misc_feature (1)..(30): oligonucleotide primer for CDC2L1 gene (positions 13028-13057)
agctgcgacttctgctacggtgatgcccac

SEQ ID NO: 446 - DNA, 33 bp, Homo sapiens
  misc_feature (1)..(33): oligonucleotide primer for CDC2L1 gene (positions 17753-17720)
ggctgggatggccttttgttcacactggttttg

SEQ ID NO: 447 - DNA, 69 bp, Artificial Sequence
  Description of Artificial Sequence: repetitive sequence found in many eutherial genomes. Length of core repeating element is varia ble and is often polymorphic
aaaaaaaaaaaaaaaaaaaaaaaaaaaaaaaaaaaaaaaaaaaaaaaaaaaaaaaaaaaaaaaaaaaaa

SEQ ID NO: 448 - DNA, 69 bp, Artificial Sequence
  Description of Artificial Sequence: repetitive sequence found in many eutherial genomes. Length of core repeating element is varia ble and is often polymorphic
ccccccccccccccccccccccccccccccccccccccccccccccccccccccccccccccccccccc

SEQ ID NO: 449 - DNA, 69 bp, Artificial Sequence
  Description of Artificial Sequence: repetitive sequence found in many eutherial genomes. Length of core repeating element is varia ble and is often polymorphic
agagagagagagagagagagagagagagagagagagagagagagagagagagagagagagagagagaga

SEQ ID NO: 450 - DNA, 69 bp, Artificial Sequence
  Description of Artificial Sequence: repetitive sequence found in many eutherial genomes. Length of core repeating element is varia ble and is often polymorphic
acacacacacacacacacacacacacacacacacacacacacacacacacacacacacacacacacaca

SEQ ID NO: 451 - DNA, 69 bp, Artificial Sequence
  Description of Artificial Sequence: repetitive sequence found in many eutherial genomes. Length of core repeating element is varia ble and is often polymorphic
caacaacaacaacaacaacaacaacaacaacaacaacaacaacaacaacaacaacaacaacaacaacaa

SEQ ID NO: 452 - DNA, 69 bp, Artificial Sequence
  Description of Artificial Sequence: repetitive sequence found in many eutherial genomes. Length of core repeating element is varia ble and is often polymorphic
caaacaaacaaacaaacaaacaaacaaacaaacaaacaaacaaacaaacaaacaaacaaacaaacaaac

SEQ ID NO: 453 - DNA, 69 bp, Artificial Sequence
  Description of Artificial Sequence: repetitive sequence found in many eutherial genomes. Length of core repeating element is varia ble and is often polymorphic
tcatcatcatcatcatcatcatcatcatcatcatcatcatcatcatcatcatcatcatcatcatcatca

SEQ ID NO: 454 - DNA, 69 bp, Artificial Sequence
  Description of Artificial Sequence: repetitive sequence found in many eutherial genomes. Length of core repeating element is varia ble and is often polymorphic
ccaccaccaccaccaccaccaccaccaccaccaccaccaccaccaccaccaccaccaccaccaccacca

SEQ ID NO: 455 - DNA, 69 bp, Artificial Sequence
  Description of Artificial Sequence: repetitive sequence found in many eutherial genomes. Length of core repeating element is varia ble and is often polymorphic
cctacctacctacctacctacctacctacctacctacctacctacctacctacctacctacctacctac

SEQ ID NO: 456 - DNA, 69 bp, Artificial Sequence
  Description of Artificial Sequence: repetitive sequence found in many eutherial genomes. Length of core repeating element is varia ble and is often polymorphic
cgcgcgcgcgcgcgcgcgcgcgcgcgcgcgcgcgcgcgcgcgcgcgcgcgcgcgcgcgcgcgcgcgcgc

SEQ ID NO: 457 - DNA, 69 bp, Artificial Sequence
  Description of Artificial Sequence: repetitive sequence found in many eutherial genomes. Length of core repeating element is varia ble and is often polymorphic
cgaacgaacgaacgaacgaacgaacgaacgaacgaacgaacgaacgaacgaacgaacgaacgaacgaac

SEQ ID NO: 458 - DNA, 69 bp, Artificial Sequence
  Description of Artificial Sequence: repetitive sequence found in many eutherial genomes. Length of core repeating element is varia ble and is often polymorphic
cggacggacggacggacggacggacggacggacggacggacggacggacggacggacggacggacggac

SEQ ID NO: 459 - DNA, 69 bp, Artificial Sequence
  Description of Artificial Sequence: repetitive sequence found in many eutherial genomes. Length of core repeating element is varia ble and is often polymorphic
gaagaagaagaagaagaagaagaagaagaagaagaagaagaagaagaagaagaagaagaagaagaagaa

SEQ ID NO: 460 - DNA, 69 bp, Artificial Sequence
  Description of Artificial Sequence: repetitive sequence found in many eutherial genomes. Length of core repeating element is varia ble and is often polymorphic
gaaagaaagaaagaaagaaagaaagaaagaaagaaagaaagaaagaaagaaagaaagaaagaaagaaag

SEQ ID NO: 461 - DNA, 69 bp, Artificial Sequence
  Description of Artificial Sequence: repetitive sequence found in many eutherial genomes. Length of core repeating element is varia ble and is often polymorphic
gacagacagacagacagacagacagacagacagacagacagacagacagacagacagacagacagacag

SEQ ID NO: 462 - DNA, 69 bp, Artificial Sequence
  Description of Artificial Sequence: repetitive sequence found in many eutherial genomes. Length of core repeating element is varia ble and is often polymorphic
ggaggaggaggaggaggaggaggaggaggaggaggaggaggaggaggaggaggaggaggaggaggagga

SEQ ID NO: 463 - DNA, 69 bp, Artificial Sequence
  Description of Artificial Sequence: repetitive sequence found in many eutherial genomes. Length of core repeating element is vari able and is often polymorphic
gcagcagcagcagcagcagcagcagcagcagcagcagcagcagcagcagcagcagcagcagcagcagca

SEQ ID NO: 464 - DNA, 69 bp, Artificial Sequence
  Description of Artificial Sequence: repetitive sequence found in many eutherial genomes. Length of core repeating element is varia ble and is often polymorphic
gccgccgccgccgccgccgccgccgccgccgccgccgccgccgccgccgccgccgccgccgccgccgcc

SEQ ID NO: 465 - DNA, 69 bp, Artificial Sequence
  Description of Artificial Sequence: repetitive sequence found in many eutherial genomes. Length of core repeating element is varia ble and is often polymorphic
gccagccagccagccagccagccagccagccagccagccagccagccagccagccagccagccagccag

SEQ ID NO: 466 - DNA, 69 bp, Artificial Sequence
  Description of Artificial Sequence: repetitive sequence found in many eutherial genomes. Length of core repeating element is varia ble and is often polymorphic
gcccgcccgcccgcccgcccgcccgcccgcccgcccgcccgcccgcccgcccgcccgcccgcccgcccg

SEQ ID NO: 467 - DNA, 69 bp, Artificial Sequence
  Description of Artificial Sequence: repetitive sequence found in many eutherial genomes. Length of core repeating element is varia ble and is often polymorphic
ggaaggaaggaaggaaggaaggaaggaaggaaggaaggaaggaaggaaggaaggaaggaaggaaggaag

SEQ ID NO: 468 - DNA, 69 bp, Artificial Sequence
  Description of Artificial Sequence: repetitive sequence found in many eutherial genomes. Length of core repeating element is varia ble and is often polymorphic
ggcaggcaggcaggcaggcaggcaggcaggcaggcaggcaggcaggcaggcaggcaggcaggcaggcag

SEQ ID NO: 469 - DNA, 69 bp, Artificial Sequence
  Description of Artificial Sequence: repetitive sequence found in many eutherial genomes. Length of core repeating element is varia ble and is often polymorphic
gggagggagggagggagggagggagggagggagggagggagggagggagggagggagggagggagggag

SEQ ID NO: 470 - DNA, 69 bp, Artificial Sequence
  Description of Artificial Sequence: repetitive sequence found in many eutherial genomes. Length of core repeating element is varia ble and is often polymorphic
atatatatatatatatatatatatatatatatatatatatatatatatatatatatatatatatatata

SEQ ID NO: 471 - DNA, 69 bp, Artificial Sequence
  Description of Artificial Sequence: repetitive sequence found in many eutherial genomes. Length of core repeating element is varia ble and is often polymorphic
taataataataataataataataataataataataataataataataataataataataataataataa

SEQ ID NO: 472 - DNA, 69 bp, Artificial Sequence
  Description of Artificial Sequence: repetitive sequence found in many eutherial genomes. Length of core repeating element is varia ble and is often polymorphic
taaataaataaataaataaataaataaataaataaataaataaataaataaataaataaataaataaat

SEQ ID NO: 473 - DNA, 69 bp, Artificial Sequence
  Description of Artificial Sequence: repetitive sequence found in many eutherial genomes. Length of core repeating element is varia ble and is often polymorphic
ctactactactactactactactactactactactactactactactactactactactactactacta

SEQ ID NO: 474 - DNA, 69 bp, Artificial Sequence
  Description of Artificial Sequence: repetitive sequence found in many eutherial genomes. Length of core repeating element is varia ble and is often polymorphic
tacatacatacatacatacatacatacatacatacatacatacatacatacatacatacatacatacat

SEQ ID NO: 475 - DNA, 69 bp, Artificial Sequence
  Description of Artificial Sequence: repetitive sequence found in many eutherial genomes. Length of core repeating element is varia ble and is often polymorphic
tagatagatagatagatagatagatagatagatagatagatagatagatagatagatagatagatagat

SEQ ID NO: 476 - DNA, 69 bp, Artificial Sequence
  Description of Artificial Sequence: repetitive sequence found in many eutherial genomes. Length of core repeating element is varia ble and is often polymorphic
tcaatcaatcaatcaatcaatcaatcaatcaatcaatcaatcaatcaatcaatcaatcaatcaatcaat

SEQ ID NO: 477 - DNA, 69 bp, Artificial Sequence
  Description of Artificial Sequence: repetitive sequence found in many eutherial genomes. Length of core repeating element is varia ble and is often polymorphic
tccatccatccatccatccatccatccatccatccatccatccatccatccatccatccatccatccat

SEQ ID NO: 478 - DNA, 69 bp, Artificial Sequence
  Description of Artificial Sequence: repetitive sequence found in many eutherial genomes. Length of core repeating element is varia ble and is often polymorphic
tgaatgaatgaatgaatgaatgaatgaatgaatgaatgaatgaatgaatgaatgaatgaatgaatgaat

SEQ ID NO: 479 - DNA, 69 bp, Artificial Sequence
  Description of Artificial Sequence: repetitive sequence found in many eutherial genomes. Length of core repeating element is varia ble and is often polymorphic
ttaattaattaattaattaattaattaattaattaattaattaattaattaattaattaattaattaat

SEQ ID NO: 480 - DNA, 35 bp, Homo sapiens
ttggctttatcataatcatcacctgctgtgaatac

SEQ ID NO: 481 - DNA, 30 bp, Homo sapiens
gcactgcttgccagctcataagtttacttc

SEQ ID NO: 482 - DNA, 30 bp, Homo sapiens
tacaggagcaagaaccaaaacaatgatagg

SEQ ID NO: 483 - DNA, 28 bp, Homo sapiens
acatgtgaggcatggacaaatgaacaac

SEQ ID NO: 484 - DNA, 27 bp, Homo sapiens
tttccatttatcagaacagaacgcaac

SEQ ID NO: 485 - DNA, 28 bp, Homo sapiens
acttgcatagcaaatagatgctactgag

SEQ ID NO: 486 - DNA, 30 bp, Homo sapiens
acttgcatagcaaatagatgctactgagtc

SEQ ID NO: 487 - DNA, 30 bp, Homo sapiens
tgacactaatgtctctaacgtctttgtgac

SEQ ID NO: 488 - DNA, 33 bp, Homo sapiens
gatgatggagtttagcagaaaatgaggagaggg

SEQ ID NO: 489 - DNA, 26 bp, Homo sapiens
agaggaggcgttgtggagaaaactgg

SEQ ID NO: 490 - DNA, 31 bp, Homo sapiens
cccattactatgtaaaattcaggagggcagc

SEQ ID NO: 491 - DNA, 31 bp, Homo sapiens
gtacagatggaatatctctggcactcattgg

SEQ ID NO: 492 - DNA, 32 bp, Homo sapiens
gtcacccagacgcacagaggagccgtctccac

SEQ ID NO: 493 - DNA, 33 bp, Homo sapiens
cgcatgaaggcgtcggggtaatgggtctcgtcg

SEQ ID NO: 494 - DNA, 33 bp, Homo sapiens
ggtccccaaagcgatacagcccaggagggagag

SEQ ID NO: 495 - DNA, 35 bp, Homo sapiens
ccgtgccctgcctaagtgagacctatgcgttaccg

SEQ ID NO: 496 - DNA, 31 bp, Homo sapiens
gcacccccacctggcttgctgcctggttaag

SEQ ID NO: 497 - DNA, 31 bp, Homo sapiens
cccggaaacccccaacgtgcctcttctcccc

SEQ ID NO: 498 - DNA, 31 bp, Homo sapiens
cagccccaaaatagccgctggagttggcccc

SEQ ID NO: 499 - DNA, 35 bp, Homo sapiens
acattgtcctaagtccacagacagcccctgccccg

SEQ ID NO: 500 - DNA, 31 bp, Homo sapiens
tcccacacagtcccctgtcatggacattgcc

SEQ ID NO: 501 - DNA, 33 bp, Homo sapiens
cacagcctggttaatattccccaccccaggagc

SEQ ID NO: 502 - DNA, 30 bp, Homo sapiens
gaaccgaagaagccacaggcagggcctgag

SEQ ID NO: 503 - DNA, 34 bp, Homo sapiens
cagacaacatcctcctccccgaacccactgttcc

SEQ ID NO: 504 - DNA, 35 bp, Homo sapiens
acagtagaaacacattgctttcactctgagcgccc

SEQ ID NO: 505 - DNA, 35 bp, Homo sapiens
tccacagaagctactttgattctctcctgccagcc

SEQ ID NO: 506 - DNA, 30 bp, Homo sapiens
caggggctgatgaattgcaacaggataggg

SEQ ID NO: 507 - DNA, 34 bp, Homo sapiens
acattctgatgatgcacattcagaccgaatctgc

SEQ ID NO: 508 - DNA, 34 bp, Homo sapiens
agcctgagtgatttaaggggttcagcaaattgac

SEQ ID NO: 509 - DNA, 34 bp, Homo sapiens
gccacagtgcttcctgatgtataacacttcttcc

SEQ ID NO: 510 - DNA, 32 bp, Homo sapiens
ctaagtgtgaagagcatgtgattccttaaaag

SEQ ID NO: 511 - DNA, 31 bp, Homo sapiens
attctgagttgataaaacttcagccagaacc

SEQ ID NO: 512 - DNA, 30 bp, Homo sapiens
taccttctgtttcatggagaagagctactt

SEQ ID NO: 513 - DNA, 30 bp, Homo sapiens
gcacctgctcagaagctaaattattacaga

SEQ ID NO: 514 - DNA, 33 bp, Homo sapiens
ctctgaagcacacacagggacccatgcccacac

SEQ ID NO: 515 - DNA, 32 bp, Homo sapiens
gggcctggttctgaaggcagcaggaactgagg

SEQ ID NO: 516 - DNA, 32 bp, Homo sapiens
tagttctaatatttatgctttttggagggtga

SEQ ID NO: 517 - DNA, 32 bp, Homo sapiens
aacaaatttattaagtggaattggaaggaact

SEQ ID NO: 518 - DNA, 30 bp, Homo sapiens
tagtgcagtgtattgtggttaagagggaag

SEQ ID NO: 519 - DNA, 32 bp, Homo sapiens
aggtatcaggctctgtgctaaatactttacag

SEQ ID NO: 520 - DNA, 35 bp, Homo sapiens
tagttaaaattataaattggacaaggtctgattcc

SEQ ID NO: 521 - DNA, 30 bp, Homo sapiens
tccttgattgcaagaaacttctatcagagt

SEQ ID NO: 522 - DNA, 30 bp, Homo sapiens
gatcaagaagaagaagaagacagccccaac

SEQ ID NO: 523 - DNA, 30 bp, Homo sapiens
taaataataacaatggacctcgaaggcagg

SEQ ID NO: 524 - DNA, 30 bp, Homo sapiens
atgctgtttctaagcgtttctttgacaagt

SEQ ID NO: 525 - DNA, 32 bp, Homo sapiens
tgttgagaacaggaaatcaacatgtaataagt

SEQ ID NO: 526 - DNA, 35 bp, Homo sapiens
tcctattgcccatatctgatgctttccaccactgc

SEQ ID NO: 527 - DNA, 35 bp, Homo sapiens
agaaacagcgtttcttttgacagccacactgacag

SEQ ID NO: 528 - DNA, 35 bp, Homo sapiens
gcatgattagggagaggcagcagccctgactgagc

SEQ ID NO: 529 - DNA, 32 bp, Homo sapiens
tcggtccccgtgtgagagctacagcaggtgag

SEQ ID NO: 530 - DNA, 35 bp, Homo sapiens
acgtgagcagcattgaatccccggatactggcagg

SEQ ID NO: 531 - DNA, 32 bp, Homo sapiens
gccaggcacggagacaaacactgagcccagtc

SEQ ID NO: 532 - DNA, 30 bp, Homo sapiens
cccttttgggaccagcacagagttcatgac

SEQ ID NO: 533 - DNA, 25 bp, Homo sapiens
cagacacacatcgccacgcaggacc

SEQ ID NO: 534 - DNA, 28 bp, Homo sapiens
cataacctgagcatctgagagctgctcc

SEQ ID NO: 535 - DNA, 27 bp, Homo sapiens
cagggtacagacccacacagagaacag

SEQ ID NO: 536 - DNA, 30 bp, Homo sapiens
atggaggagtgccctgagccccctgccatc

SEQ ID NO: 537 - DNA, 31 bp, Homo sapiens
ggcacacgggcctcacagggacagcacctac

SEQ ID NO: 538 - DNA, 30 bp, Homo sapiens; identical to SEQ ID NO: 536

SEQ ID NO: 539 - DNA, 30 bp, Homo sapiens; identical to SEQ ID NO: 536

SEQ ID NO: 540 - DNA, 30 bp, Homo sapiens
gggtgagtggagggagggacgctaagcagg

SEQ ID NO: 541 - DNA, 30 bp, Homo sapiens
gatgcgggggaagctgtgggagaaacgggg

SEQ ID NO: 542 - DNA, 30 bp, Homo sapiens
ccccgtttctcccacagcttcccccgcatc

SEQ ID NO: 543 - DNA, 30 bp, Homo sapiens
gtcccctcccaggctgcactcacctcgttc

SEQ ID NO: 544 - DNA, 30 bp, Homo sapiens
ggaaggtactgcaccagtcctagcaaaaag

SEQ ID NO: 545 - DNA, 31 bp, Homo sapiens
gcgttttcgcctaaaagaaagatgctctctg

SEQ ID NO: 546 - DNA, 30 bp, Homo sapiens
cccaagcaacgaagccaccaatcagagcag

SEQ ID NO: 547 - DNA, 30 bp, Homo sapiens
tgtaccgcagcgtgtaagtgtccatgtgcc

SEQ ID NO: 548 - DNA, 30 bp, Homo sapiens
cagtcccgaaaagcaagagctgagacttcc

SEQ ID NO: 549 - DNA, 32 bp, Homo sapiens
tcattcctgttgtgagccgttttcaattctcc

SEQ ID NO: 550 - DNA, 25 bp, Homo sapiens
agcttatgacttctgtctagctctg

SEQ ID NO: 551 - DNA, 24 bp, Homo sapiens
gcactaacttcctcactttaaccc

SEQ ID NO: 552 - DNA, 22 bp, Homo sapiens
tgtgaactgctcaaccgaaaac

SEQ ID NO: 553 - DNA, 25 bp, Homo sapiens
cttcttaacatgcttcctcatctcc

SEQ ID NO: 554 - DNA, 30 bp, Homo sapiens
cagagcctgtgaaggccctgagactggaag

SEQ ID NO: 555 - DNA, 30 bp, Homo sapiens
agcctcacctgctcactgtctaatgagccc

SEQ ID NO: 556 - DNA, 31 bp, Homo sapiens
cttgggcatggcatccattccatttccagag

SEQ ID NO: 557 - DNA, 32 bp, Homo sapiens
tgcatggtttggtttggtttgatgaggctgac

SEQ ID NO: 558 - DNA, 35 bp, Homo sapiens
ggcagcagagttcactttgtgtcattcacatcagg

SEQ ID NO: 559 - DNA, 35 bp, Homo sapiens
ggggaatccaaatagagagaggaaggggtagaggg

SEQ ID NO: 560 - DNA, 31 bp, Homo sapiens
gcaaggaagatccgtactacggtagtttagc

SEQ ID NO: 561 - DNA, 35 bp, Homo sapiens
gacatggttctgttatacagaaaggagggaaagtg

SEQ ID NO: 562 - DNA, 34 bp, Homo sapiens
ccctggaccaaaagcactcactacagttagaacc

SEQ ID NO: 563 - DNA, 33 bp, Homo sapiens
taaagcccacatccctgcattaggagggtcatc

SEQ ID NO: 564 - DNA, 33 bp, Homo sapiens; identical to SEQ ID NO: 563

SEQ ID NO: 565 - DNA, 35 bp, Homo sapiens
tgcttataaaaatgcacaacagggaccctctcagg

SEQ ID NO: 566 - DNA, 34 bp, Homo sapiens
gcttgtttcaccacctcactgccttggctccctc

SEQ ID NO: 567 - DNA, 35 bp, Homo sapiens
gccttcctgccagaaacactgctgtgagtgcttcc

SEQ ID NO: 568 - DNA, 30 bp, Homo sapiens
aactgattcttccccccaaaacctgtgccc

SEQ ID NO: 569 - DNA, 35 bp, Homo sapiens
ggccctaattcattgtcagagataaggccatcacc

SEQ ID NO: 570 - DNA, 30 bp, Homo sapiens
agctcatttctatgcaaaccgtgtccagcc

SEQ ID NO: 571 - DNA, 34 bp, Homo sapiens
tcccctgaatcacaactatgctaatgtagtcacc

SEQ ID NO: 572 - DNA, 30 bp, Homo sapiens
attttcgggcggtggacgaggatgggacgg

SEQ ID NO: 573 - DNA, 34 bp, Homo sapiens
gctctcctcagaaatgccaaagtggcccaggcac

SEQ ID NO: 574 - DNA, 34 bp, Homo sapiens
acacgggagaggtgctctgggtggtcatgagctg

SEQ ID NO: 575 - DNA, 34 bp, Homo sapiens
ccctgcactgggcaggacactggaaggaacgaac

SEQ ID NO: 576 - DNA, 34 bp, Homo sapiens
gccagccattcccaacttgagcccctgagagcac

SEQ ID NO: 577 - DNA, 34 bp, Homo sapiens
gcagaagctaaggctccttgccttgtcccaaccc

SEQ ID NO: 578 - DNA, 30 bp, Homo sapiens
agtcaagccgtgctctgtgactctgccccc

SEQ ID NO: 579 - DNA, 35 bp, Homo sapiens
acacgttcacccacgtttgtaaagatgccagcagc

SEQ ID NO: 580 - DNA, 33 bp, Homo sapiens
tgtgtgggcagtggggggtatggacctggagtc

SEQ ID NO: 581 - DNA, 35 bp, Homo sapiens
gcggcaggaaaagcgcagtgaggtcagccttcatc

SEQ ID NO: 582 - DNA, 34 bp, Homo sapiens
tggacgttgttttagcaaccccactcccaccacc

SEQ ID NO: 583 - DNA, 30 bp, Homo sapiens
accatcagcaggggagcaaggaggagccag

SEQ ID NO: 584 - DNA, 33 bp, Homo sapiens
ggctctgtgttcgcctatgcactggaggtgccg

SEQ ID NO: 585 - DNA, 32 bp, Homo sapiens
accacctgtcacatgcaagggctgaggggctg

SEQ ID NO: 586 - DNA, 33 bp, Homo sapiens
tggcctgaagctgtgggaaaaggcagcctggac

SEQ ID NO: 587 - DNA, 32 bp, Homo sapiens
gggagaaagcagggagggggcaggggaaggag

SEQ ID NO: 588 - DNA, 30 bp, Homo sapiens
tcccagactctggttctggctgtgggtgac

SEQ ID NO: 589 - DNA, 34 bp, Homo sapiens
cctcatcccagcaaaatgtttctgcccatcctcc

SEQ ID NO: 590 - DNA, 30 bp, Homo sapiens
gcattcccatcatcttcctacacagcccac

SEQ ID NO: 591 - DNA, 34 bp, Homo sapiens
tgcaactcacctacaacaaatgactgaaggttcc

SEQ ID NO: 592 - DNA, 35 bp, Homo sapiens
ccagagggcttggctcaaagcagtaggtattcaac

SEQ ID NO: 593 - DNA, 30 bp, Homo sapiens
ccaaccaccagacgggatgaaggcttacac

SEQ ID NO: 594 - DNA, 33 bp, Homo sapiens
ggtgacccccgtctctcctctacacgatgactc

SEQ ID NO: 595 - DNA, 30 bp, Homo sapiens
gagctgctgacagctttctgacatgggccg

SEQ ID NO: 596 - DNA, 35 bp, Homo sapiens
agggcctccatttgctttatgaaaacagccccttg

SEQ ID NO: 597 - DNA, 31 bp, Homo sapiens
cccgcttatcttccccagcatcctcgcattc

SEQ ID NO: 598 - DNA, 30 bp, Homo sapiens
acccagaaccccaccacagcctccaccagc

SEQ ID NO: 599 - DNA, 33 bp, Homo sapiens
cctcctcctcccgcaggctctgtgtctggttcc

SEQ ID NO: 600 - DNA, 35 bp, Homo sapiens
cccagcaaactaaaagtgttatgcaaatgagcacc

SEQ ID NO: 601 - DNA, 30 bp, Homo sapiens
aaaaaaatcaggcagtaccatcccagggcg

SEQ ID NO: 602 - DNA, 32 bp, Homo sapiens
ccaccgctccgtctgttcccctcccatgcaag

SEQ ID NO: 603 - DNA, 35 bp, Homo sapiens
cctgcacccgcccctctctcaccgagacatttcac

SEQ ID NO: 604 - DNA, 30 bp, Homo sapiens
tgcatgttgactccagtgcgtccctgccag

SEQ ID NO: 605 - DNA, 34 bp, Homo sapiens
tccaccaaacccatctccctcttcagggttcacc

SEQ ID NO: 606 - DNA, 30 bp, Homo sapiens
cctaagcctcctgctcgccctgctctgtgc

SEQ ID NO: 607 - DNA, 34 bp, Homo sapiens
ctggggccaccgatgcagcaatacagctaactgg

SEQ ID NO: 608 - DNA, 32 bp, Homo sapiens
cctgaggccgcagaaatgtgggttagcgtggg

SEQ ID NO: 609 - DNA, 35 bp, Homo sapiens
tggttggggagcaccgttgtctggcactaggaaag

SEQ ID NO: 610 - DNA, 33 bp, Homo sapiens
ggtttaatgggtgaaggcatgaaggaaaggctg

SEQ ID NO: 611 - DNA, 31 bp, Homo sapiens
gaagagctgagccaagttcaaagtcacgtcg

SEQ ID NO: 612 - DNA, 30 bp, Homo sapiens
agccctcctgagcacccgctgacatttccg

SEQ ID NO: 613 - DNA, 30 bp, Homo sapiens
gaaggctccagcagctccagcagctcccac

We claim:

1. A method of determining the existence of a pathological condition or disease predisposition in an individual or their offspring associated with a structural chromosome abnormality in a human, comprising the steps of:
   identifying a genomic nucleic acid probe sequence by ascertaining the nucleotide-by-nucleotide sequence of a target nucleic acid sequence;
   comparing said ascertained sequences with the sequences of SEQ ID Nos. 1–428 and 447–479 in said target nucleic acid sequence using a computer program;
   identifying a sequence that is free of SEQ ID Nos. 1–428 and 447–479 from said comparison;
   developing said genomic nucleic acid probe from said identified sequence, said identified sequence further being complementary to a non-repetitive portion of the target which hybridizes to at least a part of said identified genomic nucleic acid sequence;
   providing a separate, pair of said genomic nucleic acid probes designed to respectively hybridize on opposite sides of said abnormality, said nucleic acid probes having at least 50 nucleotides, appearing up to three times in a haploid genome, being free of SEQ ID NOS 1–428 and 447–479, and having a known set of sequence coordinates that define the position of said probe in reference to its location on a chromosome without a structural abnormality;
   reacting said pair of probes with a chromosomal target sequence containing said abnormality, and causing the probes to hybridize to the target sequence without requiring prehybridizing or cohybridizing of said probes with unlabeled repetitive DNA sequences to provide hybridization specificity; and
   detecting said hybridized probes as a way of ascertaining the existence of said chromosome abnormality, wherein the existence of said chromosome abnormality is indicative of the existence of said pathological condition or disease predisposition in said individual or their offspring.

2. The method of claim 1, including a step of providing a first plurality of said separate, genomic nucleic acid probes, each of said nucleic acid probes having at least 50 nucleotides, appearing up to three times in a haploid genome, being free of SEQ ID NOS 1–428 and 447–479, being distinct from one another and having a known set of sequence coordinates that define the position of said probe in reference to its location on a chromosome without a structural abnormality and designed to hybridize on one side of said abnormality, and providing a second plurality of separate, nucleic acid probes, said nucleic acid probes having at least 50 nucleotides, appearing up to three times in a haploid genome, being free of SEQ ID NOS 1–428 and 447–479, and having a known set of sequence coordinates that define the position of said probe in reference to its location on a chromosome without a structural abnormality and designed to hybridize on the other side of said abnormality.

3. The method of claim 1, said method further including the step of localizing the genomic interval within which said abnormality exists by comparing the hybridization pattern of said pair of genomic nucleic acid probes on a chromosome containing said abnormality with the hybridization pattern of said first and second nucleic acid probes on a chromosome without said abnormality.

4. A method of detecting and localizing the interval within which a human structural chromosomal abnormality exists, said abnormality being associated with a pathological condition or disease predisposition in an individual or their offspring, said abnormality being selected from the group consisting of aneuploidy, extra or missing portions of a chromosome, and chromosomal rearrangements, said method comprising the steps of:
   selecting a first and a second genomic DNA sequence by ascertaining the nucleotide-by-nucleotide sequence of a target nucleic acid sequence suspected to contain said abnormality, comparing said ascertained sequences with the sequences of SEQ ID Nos. 1–428 and 447–479 in said target nucleic acid sequence using a computer program, and identifying said first and second genomic DNA sequences from said comparison, each said genomic DNA sequence having at least 50 nucleotides, appearing up to three times in the haploid genome, being free of SEQ ID Nos. 1–428 and 447–479, having a known set of sequence coordinates that define the position of said sequence in reference to its location on a chromosome without a structural abnormality, and being derived from the same chromosome;
   hybridizing said genomic DNA sequences with a target region of human DNA having a suspected structural chromosomal abnormality without requiring prehybridizing or cohybridizing of said probes with unlabeled repetitive DNA sequences to provide hybridization specificity, said target region of DNA being from the same chromosome as said first and second genomic DNA sequences;
   detecting the location of the hybridization of each of said first and second genomic DNA sequences within said target region; and
   comparing said detected hybridization locations with the sequence coordinates that define the position of said sequences in reference to their location on a chromosome without a structural abnormality, and thereby determining the interval within which the abnormality occurs.

5. The method of claim 4, said hybridization step using a method selected from the group consisting of Southern Blot, fluorescence in-situ hybridization, array comparative genomic hybridization, chromating hybridization and bead-array genomic hybridization.

6. The method of claim 4, each of said genomic DNA sequences having at least about 500 nucleotides.

7. The method of claim 4, further including the step of selecting additional genomic DNA sequences, each said genomic DNA sequence having at least 50 nucleotides, appearing up to three times in the haploid genome, being free of SEQ ID Nos. 1–428 and 447–479, having a known set of sequence coordinates that define the position of said sequence in reference to its location on a chromosome without a structural abnormality, and being derived from the same chromosome.

8. The method of claim 7, further including the steps of:
   hybridizing said additional genomic DNA sequences with said target region of DNA;
   detecting the location of the hybridization of each of said additional genomic DNA sequences within said target region; and
   comparing said detected hybridization locations with the hybridization location of DNA without a structural abnormality.

9. A method of selecting a probe for determining the existence and or interval of a human structural chromosomal abnormality within a target region of DNA, said abnormality being associated with a pathological condition or disease predisposition in an individual or their offspring and being selected from the group consisting of aneuploidy, extra or missing portions of a chromosome, and chromosomal rearrangements, said method comprising the steps of:

a) relating genomic intervals in chromosomal regions to said pathological condition or disease predisposition in an individual or their offspring;

b) selecting a first genomic DNA interval that falls within said region, said genomic interval being from DNA which does not have said abnormality and including at least one repetitive sequence having a length of at least 50 nucleotides and appearing at least 10 times in the genome of the organism;

c) selecting a second genomic DNA interval within said first genomic interval by comparing said second genomic interval with SEQ ID Nos. 1–428 and 447–479 using a computer program, said second genomic interval having at least 50 nucleotides, appearing up to three times in the haploid genome of the organism, being free of SEQ ID NOS 1–428 and 447–479, and comprising DNA sequences from a set of known coordinates in the genome of an individual that lacks a structural chromosomal abnormality within said target region of DNA; and d) selecting said second genomic interval for use as said probe.

10. The method of claim 9, further including the step of hybridizing said second genomic interval with said target region DNA without requiring prehybridizing or cohybridizing of said probes with unlabeled repetitive DNA sequences to provide hybridization specificity.

11. The method of claim 10, said hybridization of said second genomic interval using a method selected from the group consisting of Southern Blot, fluorescence in-situ hybridization, array comparative genomic hybridization, chromating hybridization, and bead-array genomic hybridization.

12. The method of claim 9, said target region of DNA comprising a chromosome region of the human with the suspected chromosomal abnormality.

13. The method of claim 9, each of said first and second genomic DNA intervals having at least about 500 nucleotides.

14. The method of claim 9, further including the step of repeating steps a–d a second time to select a second probe.

15. A method of detecting and localizing the interval within which a human structural chromosomal abnormality exists, said abnormality being associated with a pathological condition or disease predisposition in an individual or their offspring and being selected from the group consisting of aneuploidy, extra or missing portions of a chromosome, and chromosomal rearrangements, said method comprising the steps of:

selecting a plurality of genomic DNA sequences by ascertaining the nucleotide-by-nucleotide sequence of a target nucleic acid sequence suspected to contain said abnormality, comparing said ascertained sequences with the sequences of SEQ ID Nos. 1–428 and 447–479 in said target nucleic acid sequence using a computer program, and identifying said genomic DNA sequences from said comparison, each said genomic DNA sequence having at least 50 nucleotides, appearing up to three times in the haploid genome, being free of SEQ ID NOS 1–428 and 447–479, having a known set of sequence coordinates that define the position of said genomic DNA sequence in reference to its location on a chromosome without a structural abnormality, and being derived from the same chromosome;

hybridizing said genomic DNA sequences with a target region of DNA having a suspected structural chromosomal abnormality without requiring prehybridizing or cohybridizing of said genomic DNA sequences with unlabeled repetitive DNA sequences to provide hybridization specificity, said target region of DNA being from the same chromosome as said plurality of genomic DNA sequences;

detecting the location of the hybridization of each of said genomic DNA sequences within said target region; and comparing said detected hybridization locations with the sequence coordinates that define the position of said genomic DNA sequences in reference to its location on a chromosome without a structural abnormality, and thereby determining the interval within which the abnormality occurs.

16. A method of detecting and localizing the interval within which a human nucleic acid structural abnormality exists, said abnormality being associated with a pathological condition or disease predisposition in an individual or their offspring, said method comprising the steps of:

selecting a first and a second genomic DNA sequence by ascertaining the nucleotide-by-nucleotide sequence of a target nucleic acid sequence suspected to contain said abnormality, comparing said ascertained sequences with the sequences of SEQ ID Nos. 1–428 and 447–479 in said target nucleic acid sequence using a computer program, and identifying said first and second genomic DNA sequences from said comparison, each said genomic DNA sequence having at least 50 nucleotides, appearing up to three times in the haploid genome, being free of SEQ ID Nos. 1–428 and 447–479, having a known set of sequence coordinates that define the position of said sequence in reference to its location on a chromosome without a structural abnormality, and being derived from the same chromosome;

hybridizing said first and second genomic DNA sequences with a target region of human nucleic acid having a suspected structural abnormality without requiring prehybridizing or cohybridizing of said probes with repetitive nucleic acid sequences to provide hybridization specificity, said target region of nucleic acid being derived from the same chromosome as said first and second genomic DNA sequences;

detecting the location of the hybridization of each of said first and second genomic DNA sequences within said target region; and comparing said detected hybridization locations with the sequence coordinates that define the position of said genomic DNA sequences in reference to their location in a nucleic acid sequence without a structural abnormality, and thereby determining the interval within which the abnormality occurs.

17. A method of selecting a probe for determining the existence and or interval of a human nucleic acid abnormality within a target region of nucleic acid, said abnormality being associated with a pathological condition or disease predisposition in an individual or their offspring, said method comprising the steps of:

a) relating nucleic acid intervals to said pathological condition or disease predisposition in an individual or their offspring;
b) selecting a first nucleic acid interval that falls within said target region, said nucleic acid interval being from nucleic acid which does not have said abnormality and including at least one repetitive sequence having a length of at least 50 nucleotides and appearing at least 10 times in the nucleic acid sequence of the organism;
c) selecting a second nucleic acid interval within said first nucleic acid interval by comparing said second interval with SEQ ID Nos. 1–428 and 447–479 using a computer program, said second interval having at least 50 nucleotides, appearing up to three times in the haploid genome of the organism, being free of SEQ ID NOS 1–428 and 447–479, and comprising nucleic acid sequences from a set of known coordinates in the genome of an individual that lacks a structural nucleic acid abnormality within said target region of nucleic acid; and
d) selecting said second interval for use as said probe.

18. The method of claim 1, said probes being labeled.

19. The method of claim 4, said genomic DNA sequences being labeled.

20. The method of claim 9, said probe being labeled.

21. The method of claim 15, said genomic DNA sequences being labeled.

22. The method of claim 16, said genomic DNA sequences being labeled.

23. The method of claim 17, said genomic DNA sequences being labeled.

* * * * *